(12) United States Patent
Champion et al.

(10) Patent No.: US 9,987,314 B2
(45) Date of Patent: Jun. 5, 2018

(54) ONCOLYTIC ADENOVIRUSES ARMED WITH HETEROLOGOUS GENES

(71) Applicant: PSIOXUS THERAPEUTICS LIMITED, Oxfordshire (GB)

(72) Inventors: Brian Robert Champion, Oxfordshire (GB); Alice Claire Noel Brown, Oxfordshire (GB); Kerry David Fisher, Oxfordshire (GB); Tamara Nicolson, London (GB)

(73) Assignee: Psioxus Therapeutics Limited, Oxfordshire (GB)

( * ) Notice: Subject to any disclaimer, the term of this patent is extended or adjusted under 35 U.S.C. 154(b) by 0 days. days.

(21) Appl. No.: 15/031,716

(22) PCT Filed: Oct. 24, 2014

(86) PCT No.: PCT/EP2014/072919
§ 371 (c)(1),
(2) Date: Apr. 22, 2016

(87) PCT Pub. No.: WO2015/059303
PCT Pub. Date: Apr. 30, 2015

(65) Prior Publication Data
US 2016/0331793 A1 Nov. 17, 2016

(30) Foreign Application Priority Data

| Oct. 25, 2013 | (GB) | 1318880.0 |
| Oct. 25, 2013 | (GB) | 1318885.9 |
| Dec. 23, 2013 | (GB) | 1322851.5 |
| Jan. 23, 2014 | (GB) | 1401159.7 |
| Apr. 10, 2014 | (GB) | 1406470.3 |

(51) Int. Cl.
*A61K 35/761* (2015.01)
*A61K 39/00* (2006.01)
*C12N 7/00* (2006.01)

(52) U.S. Cl.
CPC ........ *A61K 35/761* (2013.01); *A61K 39/0011* (2013.01); *C12N 7/00* (2013.01); *A61K 2039/5256* (2013.01); *C12N 2710/10332* (2013.01); *C12N 2710/10343* (2013.01)

(58) Field of Classification Search
None
See application file for complete search history.

(56) References Cited

U.S. PATENT DOCUMENTS

| 7,510,868 B2 * | 3/2009 | Harden | C12N 7/00 435/320.1 |
| 8,052,965 B2 | 11/2011 | Van Beusechem et al. | |
| 2004/0213764 A1 | 10/2004 | Wold et al. | 424/93.2 |
| 2006/0292682 A1 | 12/2006 | Hawkins et al. | |
| 2013/0243731 A1 | 9/2013 | Dias et al. | 424/93.2 |

FOREIGN PATENT DOCUMENTS

| CN | 102586327 A | 7/2012 |
| WO | 0015823 A1 | 3/2000 |
| WO | WO 2005/086922 A2 | 9/2005 |
| WO | WO 2005/107474 A2 | 11/2005 |
| WO | WO 2005/118825 A2 | 12/2005 |
| WO | WO 2006/060314 A2 | 6/2006 |
| WO | 2014138314 A1 | 9/2014 |
| WO | 2015077624 A1 | 5/2015 |
| WO | 2016174200 A1 | 11/2016 |

OTHER PUBLICATIONS

Holterman et al.; J. Virol. 2004, 78(23)13207-13215 (Year: 2004).*
Stone et al, "The complete nucleotide sequence, genome organization, and origin of human adenovirus type 11," Virol., 309 (2003) 152-165.
Ibrahimi et al., "Highly Efficient Multicistronic Lentiviral Vectors with Peptide 2A Sequences", Human Gene Therapy 20:845-860 (Aug. 2009).
Office Action dated Feb. 2, 2017 for U.S. Appl. No. 15/303,505, filed Oct. 11, 2016.
Paul et al., "The combination of a chemokine, cytokine and TCR-based T cell stimulus for effective gene therapy of cancer", Cancer Immunol Immunother. Dec. 2002;51(11-12):645-54. Epub Oct. 9, 2002.
Final Office Action dated Jun. 5, 2017 for U.S. Appl. No. 15/303,505, filed Oct. 11, 2016.
Non-Final Office Action for U.S. Appl. No. 15/303,505 dated Nov. 3, 2017.
Choi, et al., "Concurrent delivery of GM-CSF and B7-1 using an oncolytic adenovirus elicits potent antitumor effect", Gene Ther. 13(13), 2006, 1010-1020.
Jin, et al., "Identification of novel insertion sites in the Ad5 genome that utilize the Ad splicing machinery for therapeutic gene expression", Mol Ther. 12(6), 2005, 1052-1063.
Lee et al., "Enhanced antitumor effect of oncolytic adenovirus expressing interleukin-12 and B7-1 in an immunocompetent murine model", Clin Cancer Res. 12(19), 2006, 5859-5868.

(Continued)

*Primary Examiner* — James D Schultz
(74) *Attorney, Agent, or Firm* — Saul Ewing Arnstein & Lehr LLP; Debora Plehn-Dujowich

(57) ABSTRACT

The present disclosure relates to a group B adenovirus comprising a sequence of formula (I): 5'ITR-B1-BAB2-BX-BB-BY-B3-3'ITR wherein: B1 is bond or comprises: E1A, E1B or E1AE1B; BA comprises: E2B-L1-L2-L3-E2A-L4; B2 is a bond or comprises: E3; BX is a bond or a DNA sequence comprising: a restriction site, one or more transgenes or both; BB comprises L5; BY is a bond or a DNA sequence comprising: a restriction site, one or more transgenes or both; B3 is a bond or comprises: E4; wherein at least one of BX or BY is not a bond, pharmaceutical compositions comprising the same and use of the viruses and compositions in treatment, particularly in the treatment of cancer. The disclosure also extends to plasmids and processes employed to prepare the said viruses.

23 Claims, 49 Drawing Sheets

(56) References Cited

OTHER PUBLICATIONS

The International Search Report and Written Opinion dated Mar. 30, 2015 in PCT/EP2014/072919.
The International Preliminary Report on Patentability dated Jan. 28, 2016.
Kuhn Irene et al., "Directed evolution generates a novel oncolytic virus for the treatment of colon cancer", *PLOS ONE*, 3(6), Jun. 18, 2008, pp. e2409/1-e2401/11.
Alexa Frentzen et al., "Anti-VEGF single-chain antibody GLAF-1 encoded by oncolytic vaccinia virus significantly enhances antitumor therapy", *Proceedings of the National Academy of Sciences*, 106(31), Aug. 4, 2009, pp. 12915-12920.
J. D. Dias et al., "Targeted cancer immunotherapy with oncolytic adenovirus coding for a fully human monoclonal antibody specific for CTLA-4", *Gene Therapy*, 19, 2011, pp. 988-998.
Hermiston, T., "Gene delivery from replication-selective viruses: Arming guided missiles in the war against cancer", *Journal of Clinical Investigation*, 105(9), May 1, 2000, pp. 1169-1172.
Lotta Kangasniemi, "Improving oncolytic adenoviral therapies for gastrointestinal cancers and tumor initiating cells", Jan. 1, 2010, pp. 1-70 (Retrieved from the internet Feb. 10, 2015: URL:https://helda.helsinki.fi/bitstream/handle/10138/20501/improvin.pdf?sequence=1.
Non-Final Office Action issued for U.S. Appl. No. 15/107,451 dated Feb. 8, 2018.
Marino, et al., Development of a versatile oncolytic virus platform for local intra-tumoural expression of therapeutic transgenes, PLoS One. 12(5) ,2017 ,e0177810.
Champion, et al.,""Arming" the chimeric oncolytic adenovirus enadenotucirev to deliver checkpoint inhibitors and other therapeutics directly to tumours," Journal for ImmunoTherapy of Cancer 2(Suppl. 3) ,2014 ,46.
Forrester, et al.,"Serotype-Specific Inactivation of the Cellular DNA Damage Response during Adenovirus Infection," Journal of Virology 85(5) ,2011 ,2201-2211.
Jiang, et al.,"The Controlled Transgene Expression in Oncolytic Adenoviral Vectors with Major Late Promoter for Therapy of Cancer," Molecular Therapy 13(Supplement 1) ,2006 ,S251.
Liao, et al.,"Stable expression of chimeric anti-CD3 receptors on mammalian cells for stimulation of antitumor immunity," CancerGene Therapy 10 ,2003 ,779-790.
Paul, et al.,"Tumor gene therapy by MVA-mediated expression of T-cell-stimulating antibodies," Cancer Gene Therapy 9 ,2002 ,470-477.
Raum, et al.,"Abstract 2434: Novel primate-crossreactive BiTE antibodies that eliminate cancer cells expressing cMet, IGFR-1, FAP-alpha, PSCA, Endosialin, CAIX or Her2/neu," AACR 101st Annual Meeting 2010—Apr. 17-21, 2010; Washington, DC ,2010 ,Abstract Only.
Yang, et al.,"Anti-CD3 scFv-B7.1 fusion protein expressed on the surface of HeLa cells provokes potent T-lymphocyte activation and cytotoxicity," Biochem Cell Biol. 85(2) ,2007 ,196-202.

\* cited by examiner

Figure 10
A  NG-135
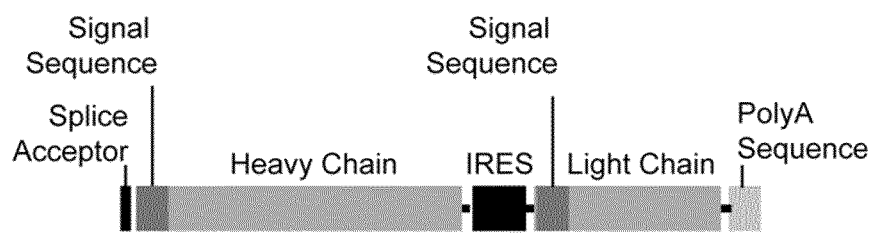
B  NG-78
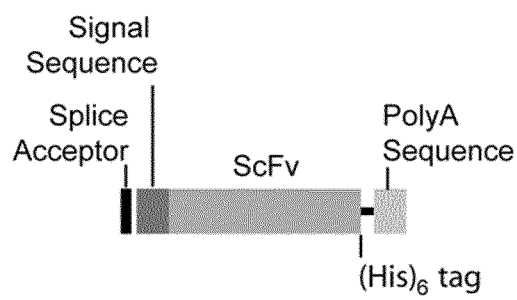
C  NG-76
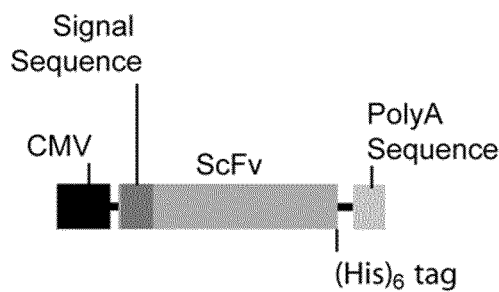

ColoAd1 = EnAd

Figure 12    ColoAd1 = EnAd
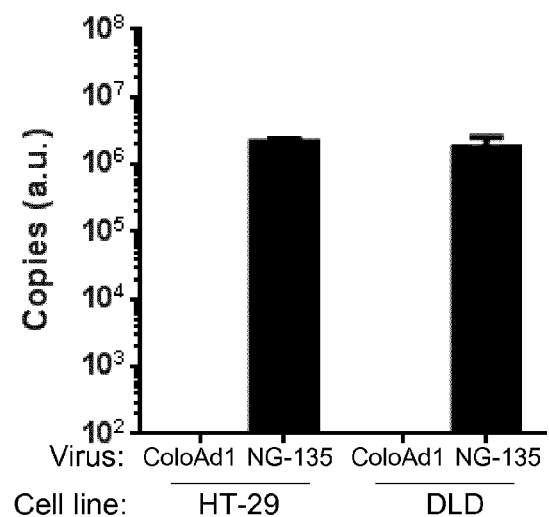
Figure 13
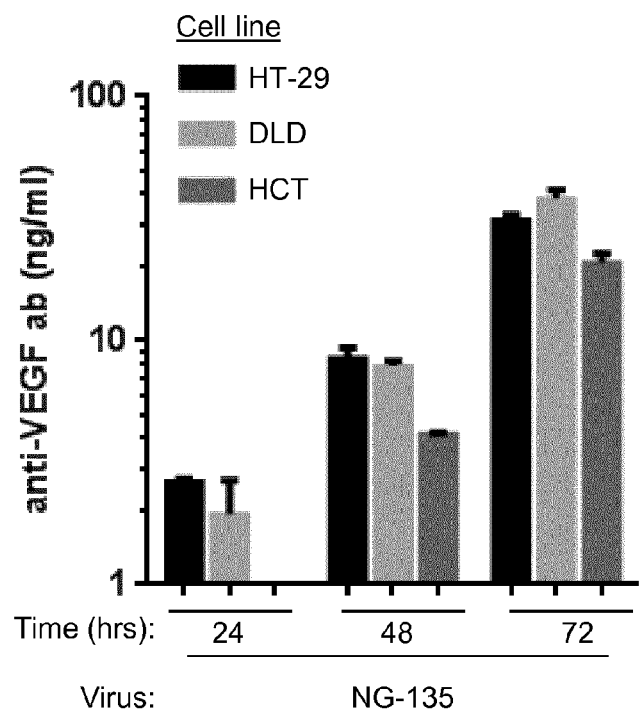

Figure 14
ColoAd1 = EnAd
A
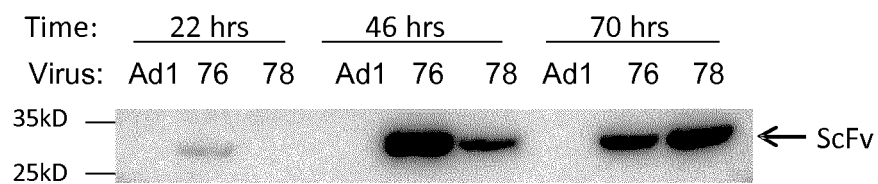
B
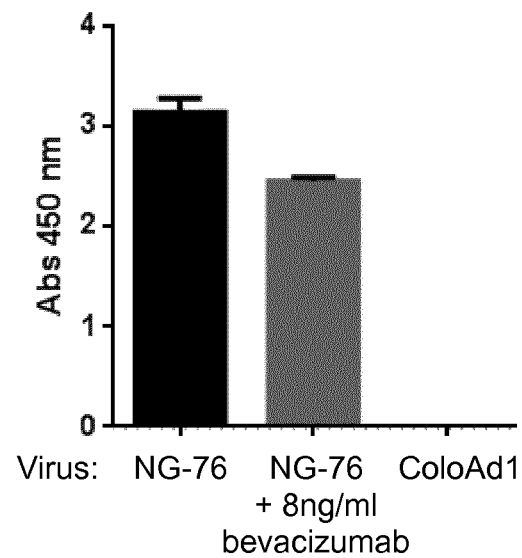

Figure 15    ColoAd1 = EnAd
A
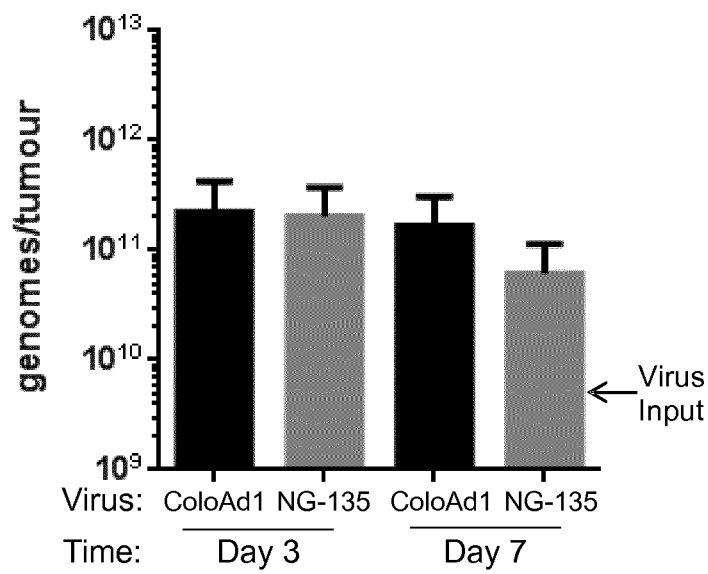
B
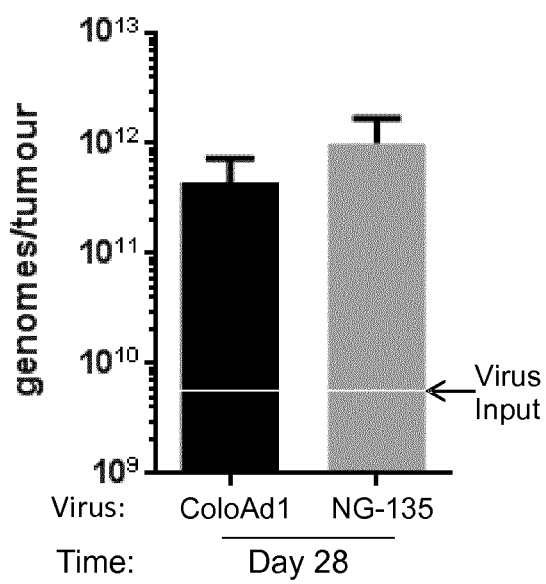

Figure 16    ColoAd1 = EnAd
A
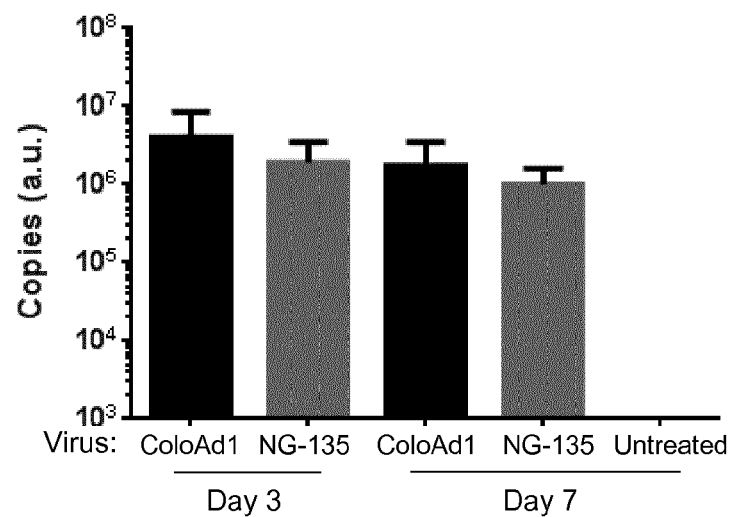
B
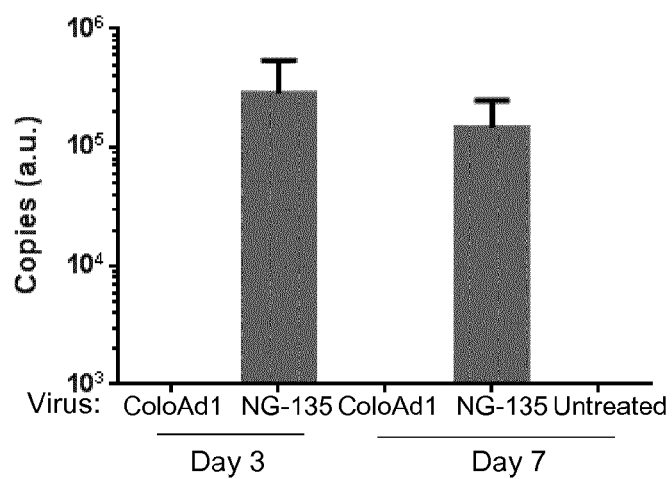

Figure 17    ColoAd1 = EnAd
A
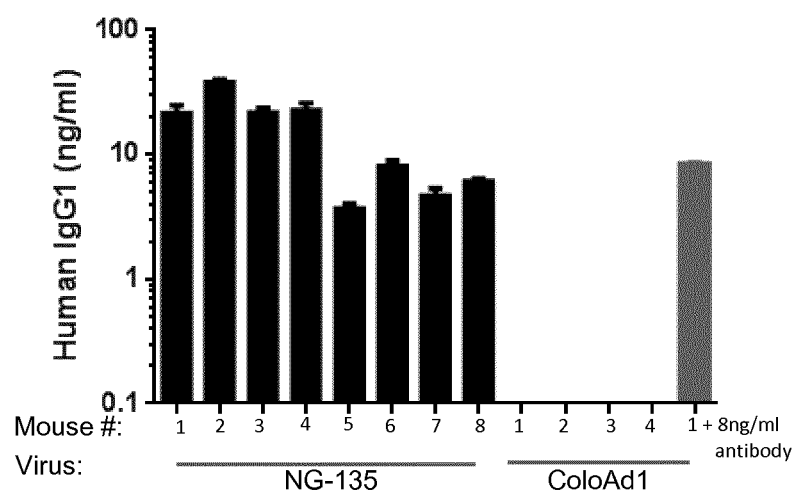
B
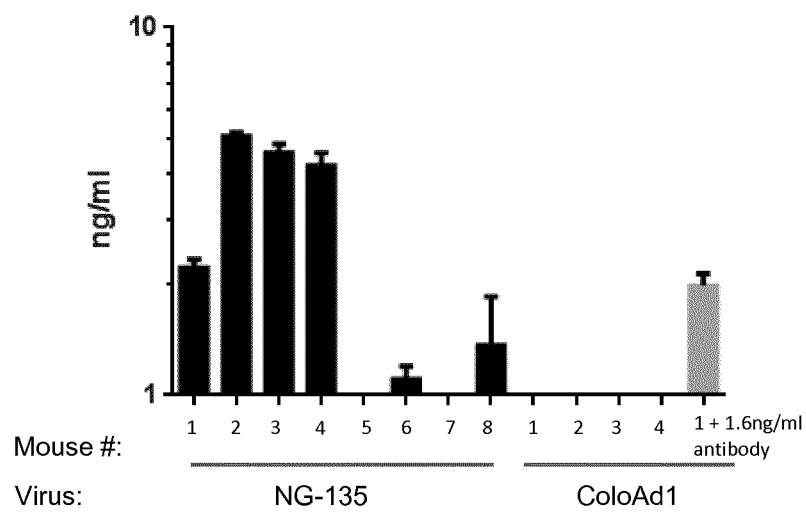

Figure 18   ColoAd1 = EnAd
A
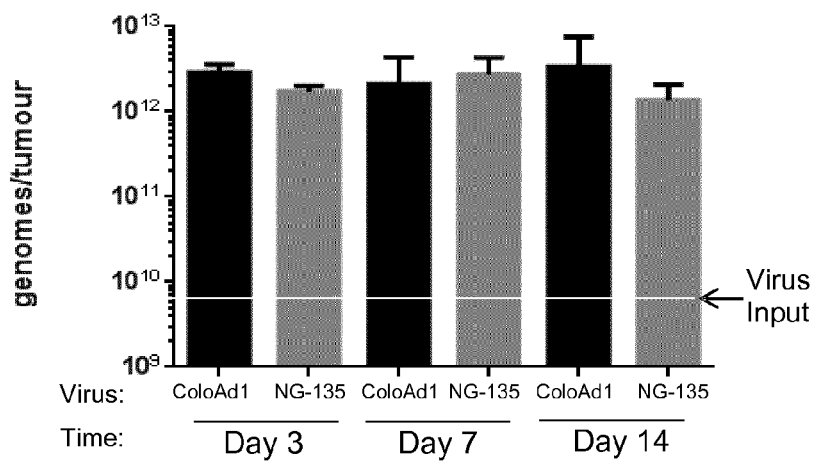
B
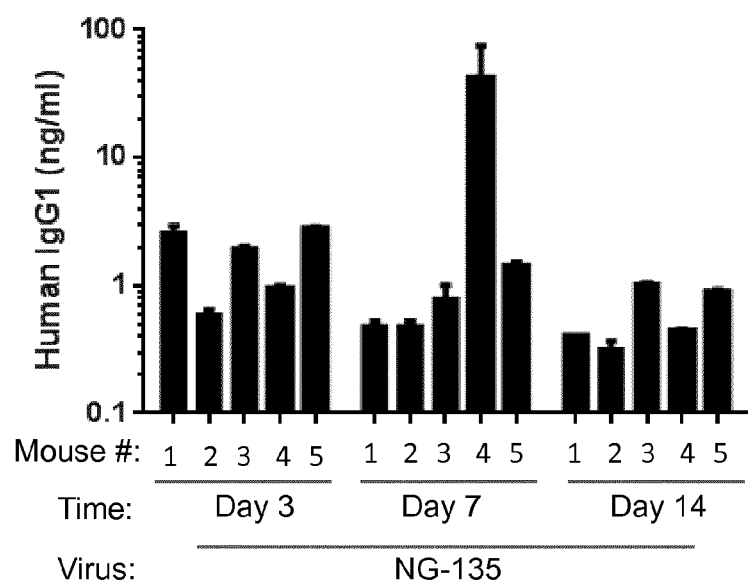

Figure 19     ColoAd1 = EnAd
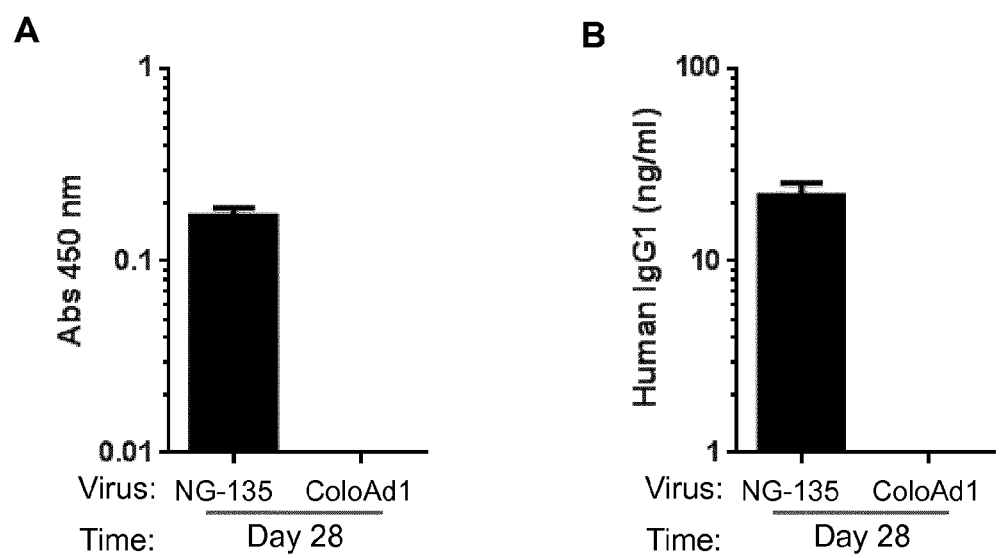

Figure 20

| | | | |
|---|---|---|---|
| Exogenous promoters | CMV | 572bp | SEQ ID NO. 13 |
| | PGK | 505bp | SEQ ID NO. 14 |
| | CBA | 278bp | SEQ ID NO. 15 |
| Splice Acceptors | SSA | 4bp | SEQ ID NO. 16 |
| | SA | 14bp | SEQ ID NO. 17 |
| | bSA | 26bp | SEQ ID NO. 18 |
| Internal Ribosome Entry Sequences | FMDV IRES | 550bp | SEQ ID NO. 19 |
| Polyadenylation (PA) signal sequences | SV40 PolyA | 220bp | SEQ ID NO. 20 |
| Signal Peptides | HuVH | 57bp/19aa | SEQ ID NO. 21 |
| | HG3-CL | 57bp/19aa | SEQ ID NO. 22 |
| Peptide tags | His tag | 18bp/6aa | SEQ ID NO. 23 |
| | V5 tag | 42bp/14aa | SEQ ID NO. 24 |
| High self-cleavage efficiency peptides | P2A | 66bp/22aa | SEQ ID NO. 25 |
| | T2A | 63bp/21aa | SEQ ID NO. 26 |
| | E2A | 69bp/23aa | SEQ ID NO. 27 |
| | F2A | 75bp/25aa | SEQ ID NO. 28 |

Figure 21

| | | | | |
|---|---|---|---|---|
| Antibody Variable Heavy Chains | Anti-VEGF | 369bp/123aa | SEQ ID NO. 29 |
| | Anti-PD-L1 | 354bp/118aa | SEQ ID NO. 30 |
| Antibody Variable Light Chains | Anti-VEGF | 324bp/108aa | SEQ ID NO. 31 |
| | Anti-PD-L1 | 324bp/108aa | SEQ ID NO. 32 |
| Antibody Constant Heavy Chains | hIgG1 | 990bp/330aa | SEQ ID NO. 33 |
| | hIgG1 Modified | 990bp/330aa | SEQ ID NO. 34 |
| Antibody Constant Light Chains | hKappa LC | 318bp/106aa | SEQ ID NO. 35 |
| Antibody Domains: ScFv | Anti-VEGF | 738bp/246aa | SEQ ID NO. 36 |
| | Anti-PD-L1 | 723bp/241aa | SEQ ID NO. 37 |
| Reporter Genes | GFP | 717bp/239aa | SEQ ID NO. 38 |
| | Luciferase | 1650bp/550aa | SEQ ID NO. 39 |
| Cytokines | TNFα | 624bp/208aa | SEQ ID NO. 40 |
| | IFNγ | 498bp/166aa | SEQ ID NO. 41 |
| | IFNα | 564bp/188aa | SEQ ID NO. 42 |
| Tumour Associated antigens | NY-ESO-1 | 324bp/108aa | SEQ ID NO. 43 |
| | MUC-1 | 1255aa | SEQ ID NO. 44 |

Figure 22

| Promoter | Cassette Design | | | Virus ID |
|---|---|---|---|---|
| Exogenous | CMV | GFP | PA | NG-47 |
| | PGK | GFP | PA | NG-159 |
| | CMV | Luciferase | PA | NG-61 |
| Major Late Promoter (MLP) | bSA | Luciferase | PA | NG-63 |
| | bSA | GFP | PA | NG-62 |
| | bSA | GFP | | NG-93 |
| | SA | GFP | PA | NG-108 |
| | SA | GFP | | NG-106 |
| | SSA | GFP | PA | NG-107 |
| | SSA | GFP | | NG-105 |
| E4 | PA | GFP | bSA | NG-110 |
| | | GFP | bSA | NG-109 |

Figure 23

| Promoter | Cassette Design | | | Virus ID | |
|---|---|---|---|---|---|
| Exogenous | CMV | IFNγ | PA | NG-95 | SEQ ID NO. 49 |
| | CMV | IFNα | PA | NG-97 | SEQ ID NO. 50 |
| Major Late Promoter (MLP) | bSA | IFNγ | PA | NG-92 | SEQ ID NO. 51 |
| | bSA | IFNα | PA | NG-96 | SEQ ID NO. 52 |
| | SSA | TNFα | PA | NG-139 | SEQ ID NO. 53 |

Figure 24

| Promoter | Cassette Design | Virus ID | |
|---|---|---|---|
| Exogenous | HuVH CMV — Anti-VEGF ScFv — PA | NG-73 | SEQ ID NO. 8 |
| | HuVH CMV — Anti-VEGF ScFv — His tag PA | NG-76 | SEQ ID NO. 7 |
| Major Late Promoter (MLP) | HuVH bSA — Anti-VEGF ScFv — PA | NG-74 | SEQ ID NO. 5 |
| | HuVH bSA — Anti-VEGF ScFv — His tag PA | NG-78 | SEQ ID NO. 6 |
| | HuVH SSA — Anti-VEGF ScFv — His tag PA | NG-167 | SEQ ID NO. 48 |
| | HuVH SSA — Anti-VEGF VH — hIgG1 — HG3 IRES — Anti-VEGF VL — hxLC — PA | NG-135 | SEQ ID NO. 2 |
| | HuVH SSA — Anti-PD-L1 VH — hIgG1 mod — HG3 IRES — Anti-PD-L1 VL — hxLC — PA | NG-177 | SEQ ID NO. 46 |

Figure 25    ColoAd1 = EnAd
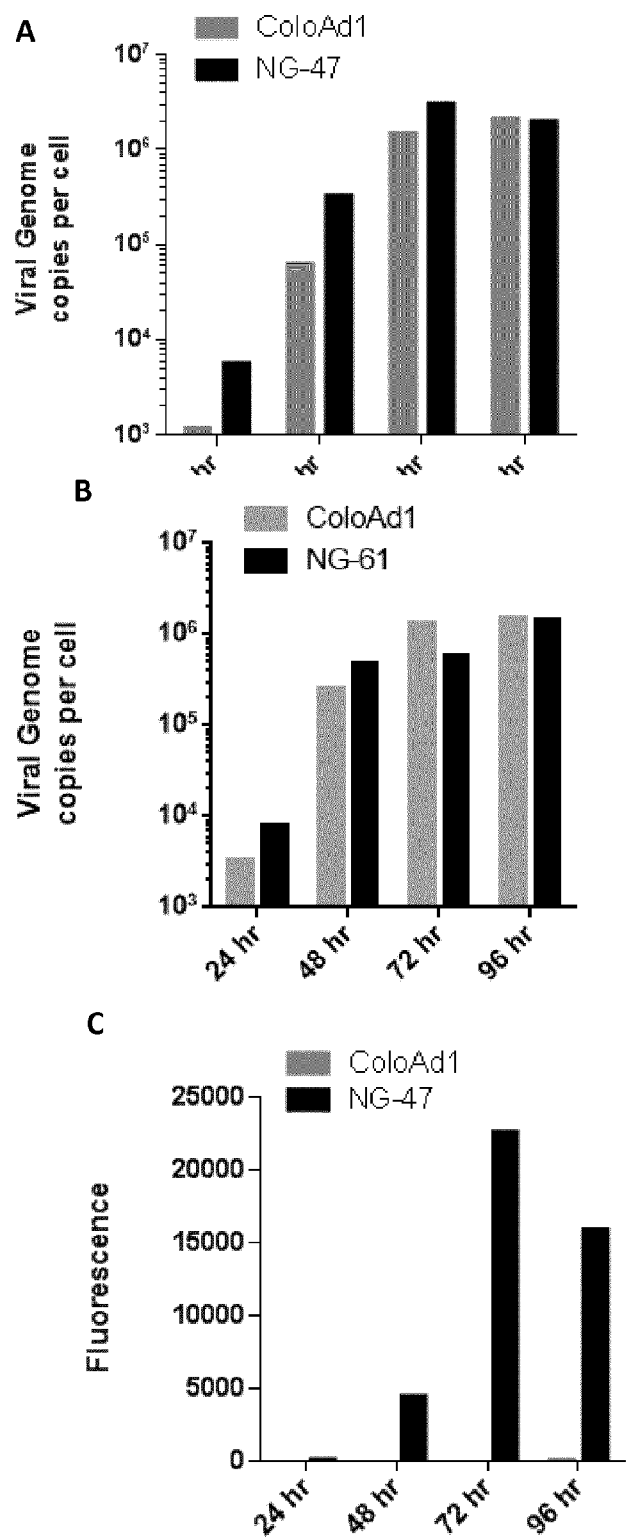

Figure 26     ColoAD1 = EnAd
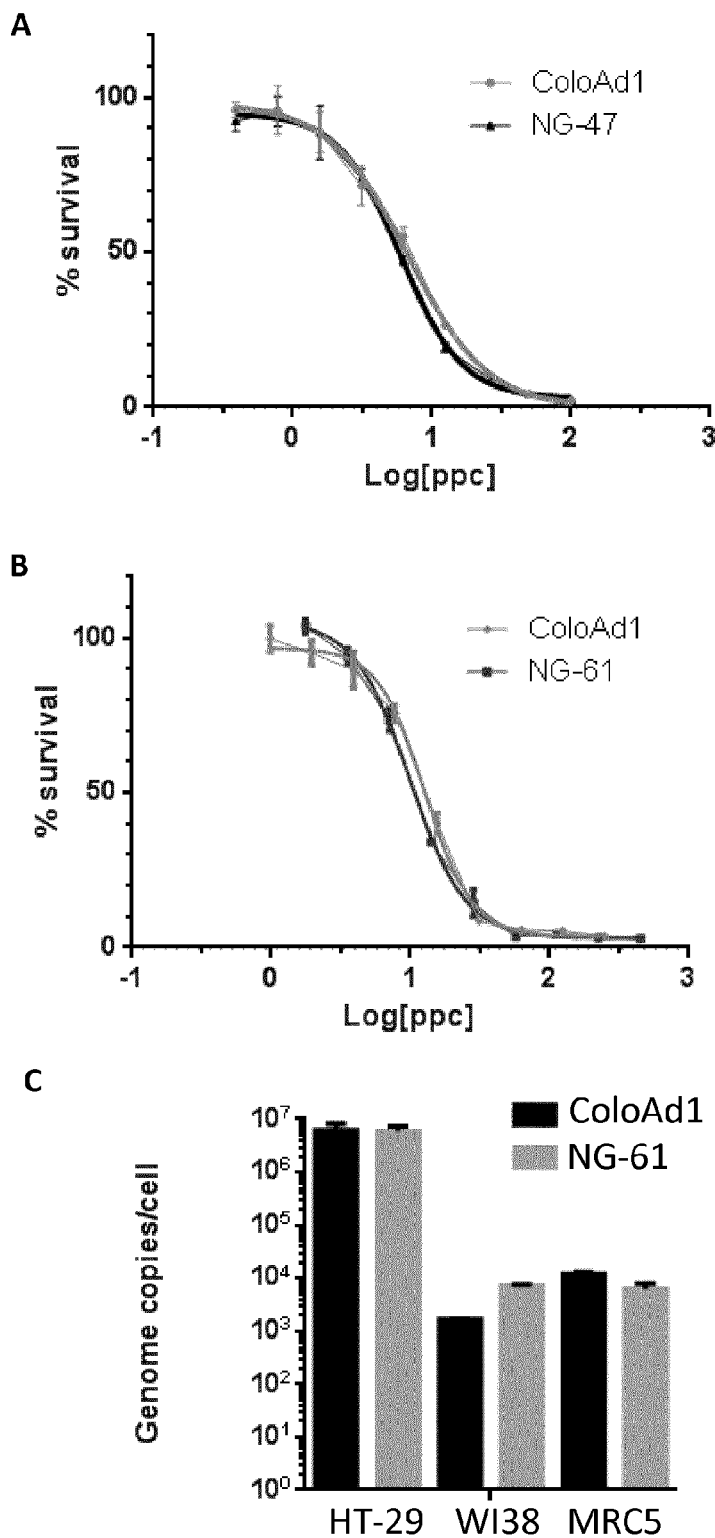

ColoAd1 = EnAd; UIC = uninfected control

Figure 29  ColoAd1 = EnAd
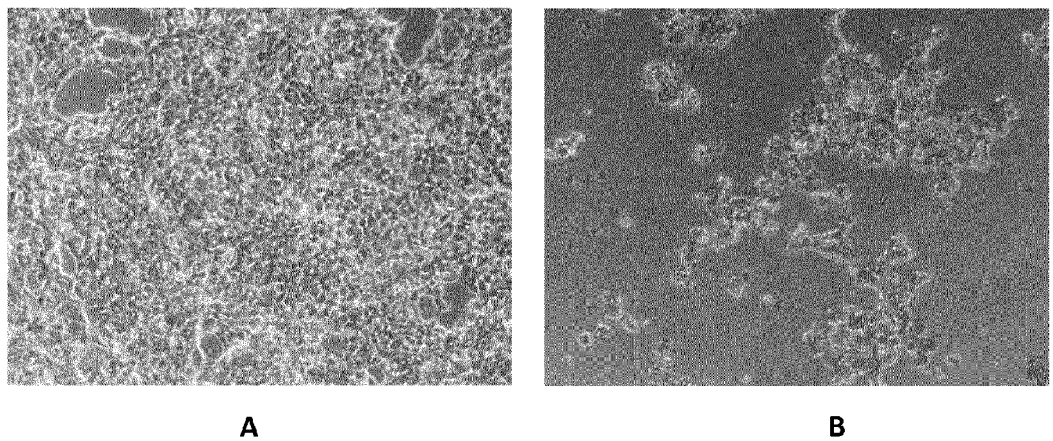
A                                                B
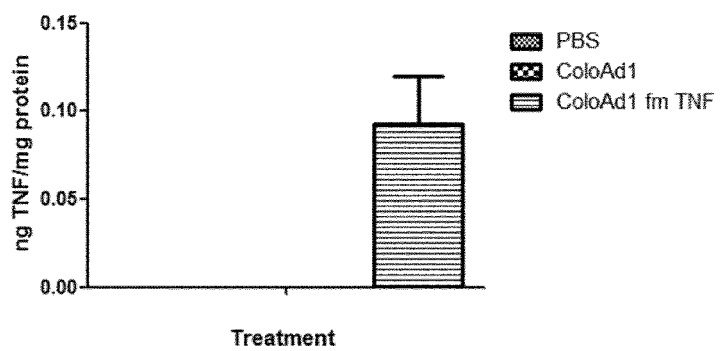

Figure 33    Ad1 = EnAD; 135 = NG-135
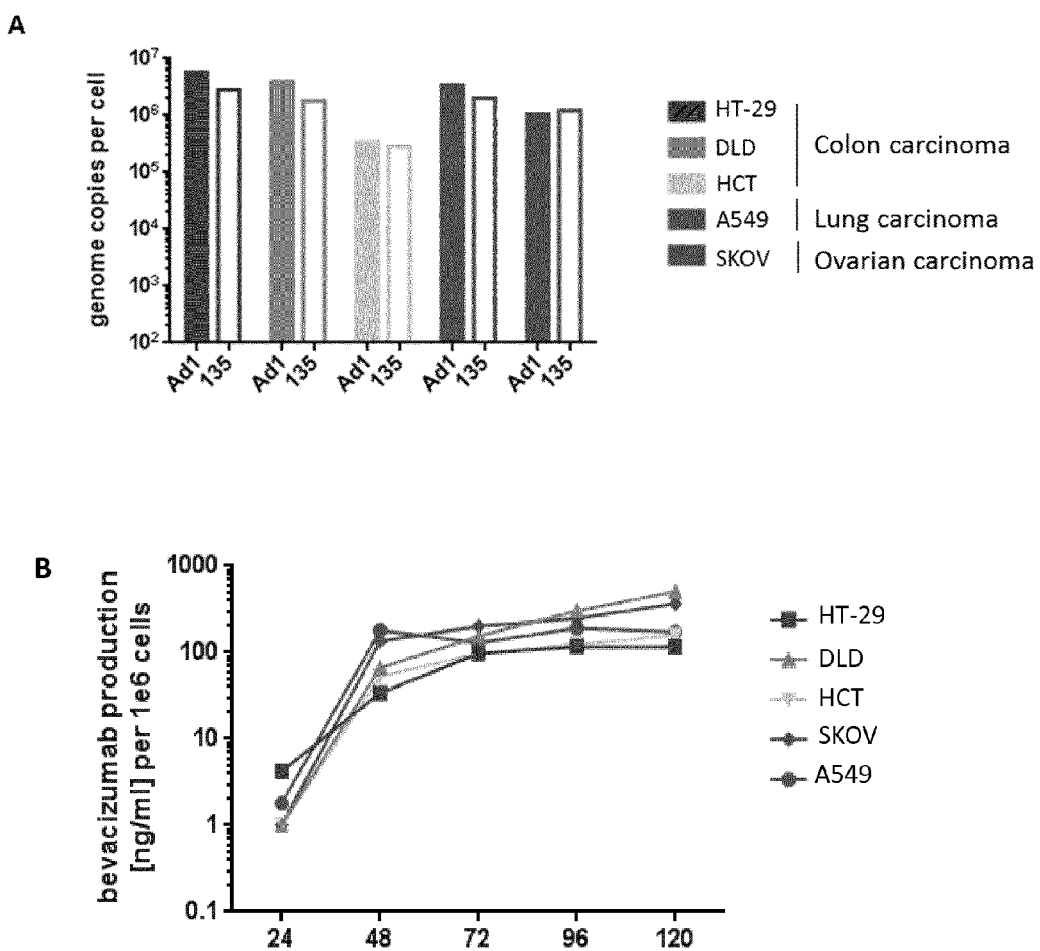

Figure 34

| Promoter | Cassette Design | Virus ID | |
|---|---|---|---|
| Exogenous | PGK — NY-ESO-1 — PA | NG-220 | SEQ ID NO.56 |
| | CMV — NY-ESO-1 — PA | NG-217 | SEQ ID NO.57 |
| | CMV — Leader (HuVH) — Anti-VEGF VH — hIgG1 — Leader (HG3) — P2A — Anti-VEGF VL — hκLC — PA | NG-258 | SEQ ID NO.62 |
| Major Late Promoter (MLP) | SSA — Leader (HuVH) — Anti-CTLA-4 VH — hIgG1 — IRES — Leader (HG3) — Anti-CTLA-4 VL — hκLC — PA | NG-242 | SEQ ID NO.58 |
| | SSA — Leader (HuVH) — Anti-VEGF VH — hIgG1 — Leader (HG3) — P2A — Anti-VEGF VL — hκLC — PA | NG-165 | SEQ ID NO.59 |
| | SSA — Leader (HuVH) — Anti-PD-L1 VH — hIgG1 — Leader (HG3) — P2A — Anti-PD-L1 VL — hκLC — PA | NG-190 | SEQ ID NO.60 |
| | SSA — Leader (HuVH) — Anti-PD-L1 ScFv — His tag — PA | NG-221 | SEQ ID NO.61 |

Figure 38
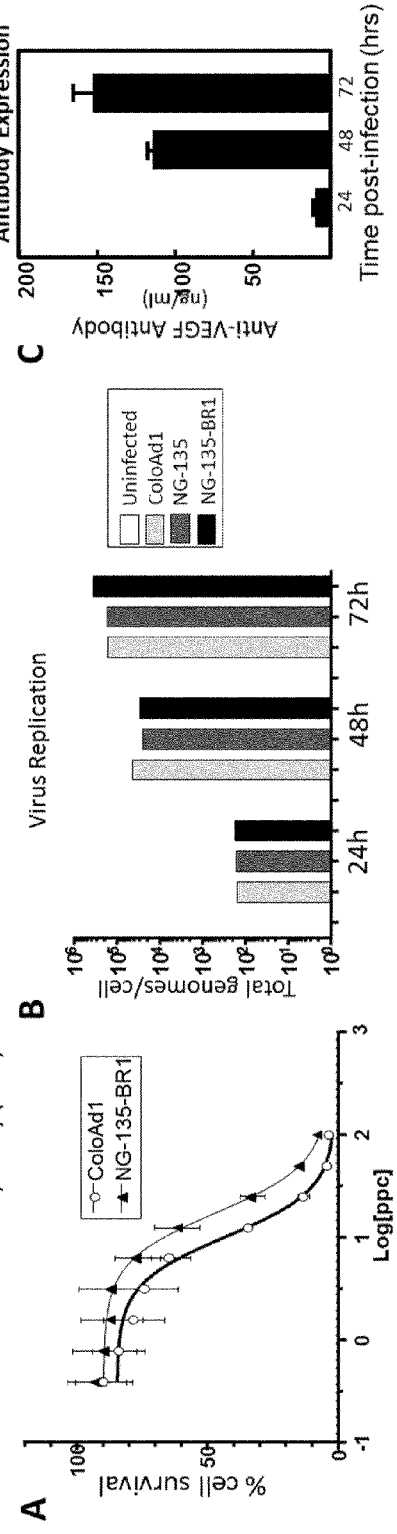
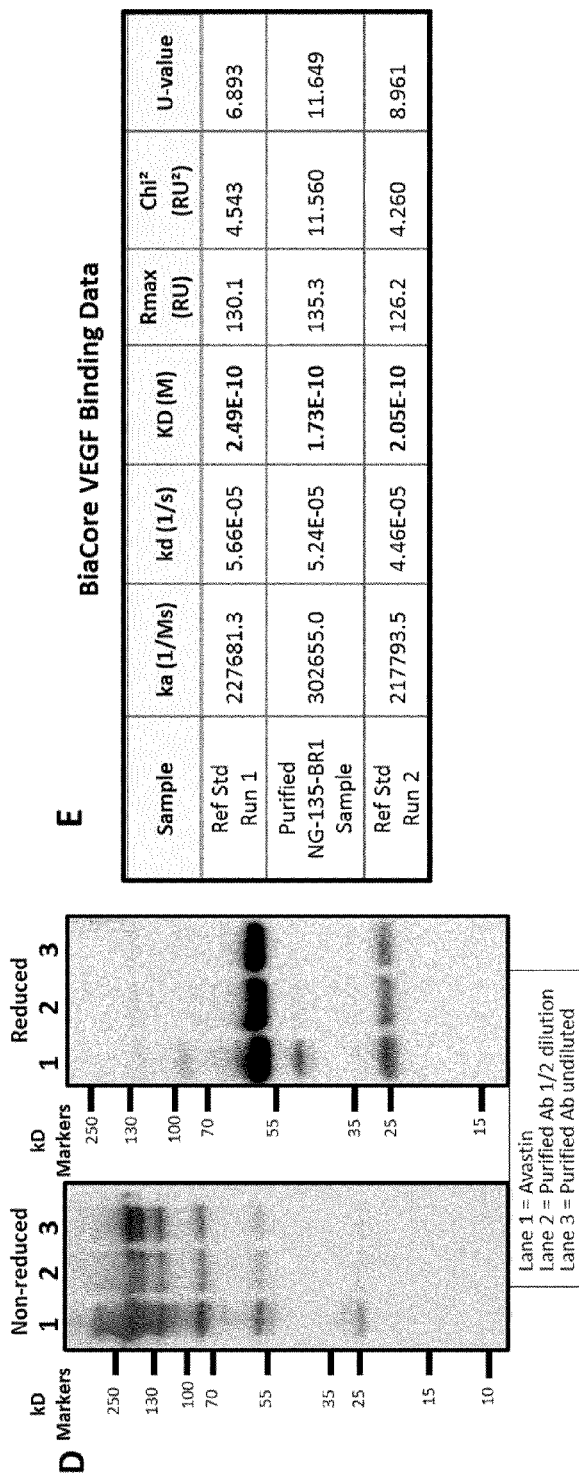

Figure 53
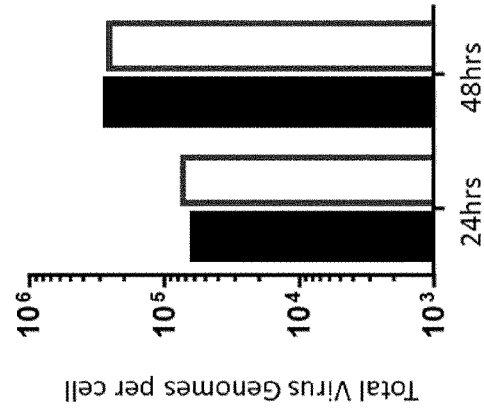
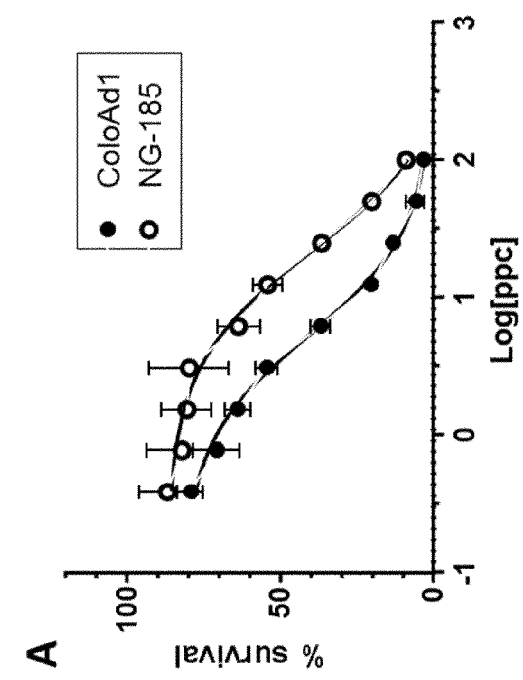

ONCOLYTIC ADENOVIRUSES ARMED WITH HETEROLOGOUS GENES

CROSS REFERENECE TO RELATED APPLICATIONS

The present invention is filed under 35 U.S.C. § 371 as the U.S. national phase of International Application No. PCT/EP2015/072919, filed Oct. 24, 2014, which designated the U.S. and claims the benefit of priority to United Kingdom Patent Application Nos. 1318880.0 filed Oct. 25, 2013, 1318885.9 filed Oct. 25, 2013, 1322851.5 filed Dec. 23, 2013, 1401159.7 filed Jan. 23, 2014, and 1406470.3 filed Apr. 10, 2014, each of which is hereby incorporated in its entirety including all tables, figures and claims.

SEQUENCE LISTING

The instant application contains a Sequence Listing which has been submitted in ASCII format via EFS-Wed and is hereby incorporated by reference in its entirety. Said ASCII copy, created on Aug. 2, 2016, is named STPS100_US_SeqList.txt and is 1498 kilobytes in size.

The present disclosure relates to a modified adenovirus, for example armed with at least one transgene including a therapeutic and/or reporter transgene, in particular a group B virus, such as a serotype 11 adenovirus or a chimeric virus with the fibre, penton and hexon of Ad11, a composition, such as a pharmaceutical formulation comprising the virus, use of the virus and virus formulations, particularly in treatment, especially in the treatment of cancer. The disclosure also extends to processes for preparing the virus.

BACKGROUND

Replication deficient adenoviruses vectors have been investigated for a number of years for the delivery of transgenes. Mostly the genes have been inserted in the E1 region and/or the E3 region because these regions of the viral genome are non-essential for vectors.

Surprisingly relatively little work has been done on alternative locations for inserting transgenes in the adenovirus genome. In addition most of the work has been performed in Ad5.

A new generation of replication competent oncolytic adenoviruses is currently in the clinic. These viruses do not require complementing cell lines to replicate. E1 is an essential region to viral replication and whilst the E3 region in theory can be used as a location to insert a transgene, it would be useful to be able to insert a transgene in more than this location. However, care has to be taken not to disrupt the virus life cycle and/or advantageous viral properties, such as the therapeutic properties of the virus.

Enadenotucirev (EnAd) is a chimeric oncolytic adenovirus, formerly known as EnAd (WO2005/118825), with fibre, penton and hexon from Ad11p, hence it is a subgroup B virus. It has a chimeric E2B region, which comprises DNA from Ad11p and Ad3. Almost all of the E3 region and part of the E4 region is deleted in EnAd. Therefore, it has significant space in the genome to accommodate additional genetic material whilst remaining viable. Furthermore, because EnAd is a subgroup B adenovirus, pre-existing immunity in humans is less common than, for example, Ad5. Other examples of chimeric oncolytic viruses with Ad11 fibre, penton and hexon include OvAd1 and OvAd2 (see WO2006/060314).

EnAd seems to preferentially infect tumour cells, replicates rapidly in these cells and causes cell lysis. This, in turn, can generate inflammatory immune responses thereby stimulating the body to also fight the cancer. Part of the success of EnAd is hypothesised to be related to the fast replication of the virus in vivo.

Whilst EnAd selectively lyses tumour cells, it may be possible to introduce further beneficial properties, for example increasing the therapeutic activity of the virus or reducing side-effects of the virus by arming it with transgenes, such as a transgene which encodes a cell signalling protein or an antibody, or a transgene which encodes an entity which stimulates a cell signalling protein(s).

Advantageously arming a virus, with DNA encoding certain proteins that can be expressed inside the cancer cell, may enable the body's own defences to be employed to combat tumour cells more effectively, for example by making the cells more visible to the immune system or by delivering a therapeutic gene/protein preferentially to target tumour cells.

Furthermore, the ability to insert transgenes that are reporters into the genome can aid clinical or pre-clinical studies.

It is important that expression of the transgenes does not adversely affect the replication or other advantageous properties of the virus. Thus, the gene or genes must be inserted in a location that does not compromise the replication competence and other advantageous properties of the virus. In addition, the genome of adenoviruses is tightly packed and therefore it can be difficult to find a suitable location to insert transgenes. This also limits the size of transgenes that can be accommodated.

In therapeutic products it is important to control precisely the characteristics of the active agent, so it is well characterised and can reproducibly be prepared. Prior art systems using randomly inserting transposons are not well suited for use in pharmaceutical products because the transgene inserts randomly into the virus genome and the site of insertion may be influenced by the transgene itself. It can also be difficult to replace genes inserted by the transposon with alternative genes.

Thus it is desirable to develop a robust and repeatable means of generating armed adenoviruses, which is tolerant to a wide variety of transgenes.

The present inventors have developed a method of arming an adenovirus suitable for accommodating a wide variety of transgenes under the control of an endogenous or exogenous promoter that results in a viable, stable, recoverable virus which expresses the transgene in tumour cells. The method is robust and repeatable and can be strictly controllable.

The transgene is located in the proximity of (adjacent to) the gene encoding the fibre protein, either at the 5' end and/or the 3' end of the gene, which does not adversely affect the stability of the virus.

The present inventors have established that complicated proteins in the form of antibodies or antibody fragments and cell signalling proteins can be inserted in this location in the genome of adenoviruses, for example group B viruses, such as Ad11 and Ad11-derived viruses, and successfully expressed, for example under the control of the endogenous E4 or major late promoter, such that the protein is expressed and the replication of the virus is not compromised.

A plasmid developed by the present inventors provides novel restriction sites in the adenovirus genome which can be utilised for insertion of transgene cassettes near to the L5 (fibre) gene to provide viruses of the present disclosure. Alternatively, plasmids containing transgenes or transgene cassettes at these insertion site positions can be directly fully synthesized without a cloning step and thus without a need to use the restriction sites.

SUMMARY OF INVENTION

The present disclosure provides an adenovirus comprising a genome comprising the sequence of formula (I):

$$5'\text{TTR-}B_1\text{-}B_A\text{-}B_2\text{-}B_X\text{-}B_B\text{-}B_Y\text{-}B_3\text{-}3'\text{TTR} \quad (I)$$

wherein:
$B_1$ is a bond or comprises: E1A, E1B or E1A-E1B;
$B_A$ is E2B-L1-L2-L3-E2A-L4;
$B_2$ is a bond or comprises E3;
$B_X$ is a bond or a DNA sequence comprising: a restriction site, one or more transgenes or both;
$B_B$ comprises L5;
$B_Y$ is a bond or a DNA sequence comprising: a restriction site, one or more transgenes or both;
$B_3$ is a bond or comprises E4;
wherein at least one of $B_X$ and $B_Y$ is not a bond, for example at least one of $B_X$ and $B_Y$ comprises a transgene, a restriction site or both, such as a transgene.

In one embodiment $B_X$ comprises a restriction site, for example 1, 2, 3 or 4 restriction sites, such as 1 or 2. In one embodiment $B_X$ comprises at least one transgene, for example 1 or 2 transgenes. In one embodiment $B_X$ comprises at least one transgene, for example 1 or 2 transgenes and one or more restriction sites, for example 2 or 3 restriction sites, in particular where the restrict sites sandwich a gene or the DNA sequence comprising the genes to allow it/them to be specifically excised from the genome and/or replaced. Alternatively, the restriction sites may sandwich each gene, for example when there are two transgenes three different restriction sites are required to ensure that the genes can be selectively excised and/or replaced. In one embodiment one or more, for example all the transgenes are in the form a transgene cassette. In one embodiment $B_X$ comprises SEQ ID NO: 10. In one embodiment SEQ ID NO: 10 is interrupted, for example by a transgene. In embodiment SEQ ID NO: 10 is uninterrupted. In one embodiment $B_X$ does not comprise a restriction site. In one embodiment $B_X$ is a bond. In one embodiment Bx comprises or consists of one or more transgenes.

In one embodiment $B_Y$ comprises a restriction site, for example 1, 2, 3 or 4 restriction sites, such as 1 or 2. In one embodiment $B_Y$ comprises at least one transgene, for example 1 or 2 transgenes. In one embodiment $B_Y$ comprises at least one transgene, for example 1 or 2 transgenes and one or more restriction sites, for example 2 or 3 restriction sites, in particular where the restrict sites sandwich a gene or the DNA sequence comprising the genes to allow it/them to be specifically excised from the genome and/or replaced. Alternatively the restriction sites may sandwich each gene, for example when there are two transgenes three different restriction sites are required to ensure that the genes can be selectively excised and/or replaced. In one embodiment one or more, for example all the transgenes are in the form a transgene cassette. In one embodiment $B_Y$ comprises SEQ ID NO: 11. In one embodiment SEQ ID NO: 11 is interrupted, for example by a transgene. In embodiment SEQ ID NO: 11 is uninterrupted. In one embodiment $B_Y$ does not comprise a restriction site. In one embodiment By is a bond. In one embodiment $B_Y$ comprises or consists of one or more transgenes.

In one embodiment $B_X$ and $B_Y$ each comprises a restriction site, for example 1, 2, 3 or 4 restriction sites, such as 1 or 2. In one embodiment $B_X$ and $B_Y$ each comprises at least one transgene, for example 1 or 2 transgenes. In one embodiment $B_X$ and $B_Y$ each comprises at least one transgene, for example 1 or 2 transgenes and one or more restriction sites, for example 2 or 3 restriction sites, in particular where the restriction sites sandwich a gene or the DNA sequence comprising the genes to allow it to be specifically excised from the genome and/or replaced. Alternatively the restriction sites may sandwich each gene, for example when there are two transgenes three different restriction sites are required to ensure that the genes can be selectively excised and/or replaced. In one embodiment one or more, for example all the transgenes are in the form a transgene cassette. In one embodiment $B_X$ and $B_Y$ comprises SEQ ID NO: 10 and SEQ ID NO: 11 respectively. In one embodiment $B_X$ and $B_Y$ do not comprise a restriction site. In one embodiment $B_X$ is a bond and $B_Y$ is not a bond. In one embodiment $B_Y$ is a bond and $B_X$ is not a bond.

In one embodiment the transgene is located in $B_X$. In one embodiment the transgene or transgene cassette is located in $B_Y$. In one embodiment a transgene or transgene cassette is located in $B_X$ and $B_Y$, for example the transgenes may be the same or different, in each location.

Advantageously, the transgene in the present virus constructs is/are inserted in a location that is removed from the early genes because this reduces the likelihood of affecting virus gene expression or speed of replication.

In one independent aspect there is provided a replication competent oncolytic adenovirus of serotype 11 or virus-derivative thereof wherein the fibre, hexon and capsid are serotype 11, wherein the virus genome comprises a DNA sequence encoding a therapeutic antibody or antibody-binding fragment, said DNA sequence under the control of a promoter endogenous to the adenovirus selected from consisting of E4 and the major late promoter, such that the transgene does not interfere with virus replication, for example wherein the DNA sequence encoding the therapeutic antibody or antibody-binding fragment is under the control of the E4 promoter or alternatively under the control of the major late promoter, in particular wherein the DNA sequence encoding an antibody or antibody-binding fragment in located after L5 in the virus genome sequence (i.e. towards the 3' end of the virus sequence). Advantageously using an endogenous promoter maximises the amount of space available for inserting transgenes.

Advantageously, when under the control of these promoters the virus remains replication competent and is also able to express the antibody as a full length antibody or a suitable binding fragment or other protein. Thus the antibody or other protein of choice will be expressed by the cancer cell. Employing an endogenous promoter may be advantageous because it reduces the size of the transgene cassette that needs to be incorporated to express the antibody, fragment or other protein, i.e. the cassette can be smaller because no exogenous promoter needs to be included.

Employing an endogenous promoter in the virus may also be advantageous in a therapeutic context because the transgene is only expressed when the virus is replicating as opposed to a constitutive exogenous promoter which will continually transcribe the transgene and may lead to an inappropriate concentration of the antibody or fragment.

In one embodiment expression of the antibody or fragment is under the control of the major late promoter.

In one embodiment the expression of the antibody or fragment is under the control of the E4 promoter.

In one independent aspect there is provided a replication competent oncolytic adenovirus of serotype 11 or virus-derivative thereof wherein the fibre, hexon and capsid are serotype 11, wherein the virus genome comprises a DNA sequence encoding a therapeutic antibody or antibody-binding fragment located in a part of the virus genome which is expressed late in the virus replication cycle and such that the transgene does not interfere with virus replication, wherein said DNA sequence under the control of a promoter exogenous to the adenovirus, for example wherein the DNA sequence encoding the therapeutic antibody or antibody-binding fragment is under the control of the CMV promoter, in particular the DNA sequence encoding an antibody or antibody-binding fragment is located after L5 in the virus genome sequence (i.e. towards the end of the 3' end of the virus sequence).

Employing an exogenous promoter may be advantageous because it can strongly and constitutively express the antibody or fragment, which may be particularly useful in some situations, for example where the patient has very pervasive cancer.

In one embodiment expression of the antibody or fragment is under the control of a CMV promoter.

In one embodiment the exogenous promoter is associated with this DNA sequence, for example is part of the expression cassette encoding the antibody or fragment.

In one embodiment the DNA sequence encoding the antibody or fragment is located after the L5 gene in the virus sequence. Advantageously, the present inventors have established that a variety of transgenes can be inserted into $B_X$ and/or $B_Y$ under the control of an exogenous or endogenous promoter, without adversely affecting the life cycle of the virus or the stability of the vector.

In one embodiment the transgene is part of a transgene cassette comprising at least one coding sequence (i.e. at least one transgene) and optionally one or more elements independently selected from:
 i. a regulator of gene expression, such as an exogenous promoter or splice acceptor;
 ii. an internal ribosome entry (IRES) DNA sequence;
 iii. a DNA sequence encoding a high self-cleavage efficiency 2A peptide;
 iv. a DNA sequence encoding a polyadenylation sequence, and
 v. combinations of the same.

Thus in one embodiment the transgene cassette comprises i) or ii) or iii) or iv).

In one embodiment the transgene cassette comprises i) and ii), or i) and iii), or i) and iv), or ii) and iii), or ii) and iv), or iii) and iv).

In one embodiment the transgene cassette comprises i) and ii) and iii), or i) and ii) and iv), or i) and iii) and iv), or ii) and iii) and iv).

In one embodiment the transgene cassette comprises i) and ii) and iii) and iv).

In one embodiment the transgene or transgene cassette comprises a Kozak squence, which assists in the translation of mRNA, for example at the start of a protein coding sequence.

In one embodiment the virus is replication competent.

In one embodiment the virus is replication deficient, i.e. is a vector.

Also provided is a composition comprising a virus or vector according to the present disclosure, in particular a pharmaceutical composition, for example comprising an adenovirus according to the disclosure and a pharmaceutically acceptable excipient.

The present disclosure further relates to an adenovirus or composition according to the disclosure for use in treatment, for example for use in the treatment of cancer.

The disclosure also relates to a method of treatment comprising administering a therapeutically effective amount of a virus as described herein or a composition comprising the same to a patient in need thereof, in particular a human patient.

DETAILED DESCRIPTION

Transgene as employed herein refers to a gene that has been inserted into the genome sequence, which is a gene that is unnatural to the virus (exogenous) or not normally found in that particular location in the virus. Examples of transgenes are given below. Transgene as employed herein also includes a functional fragment of the gene that is a portion of the gene which when inserted is suitable to perform the function or most of the function of the full-length gene.

Transgene and coding sequence are used interchangeably herein in the context of inserts into the viral genome, unless the context indicates otherwise. Coding sequence as employed herein means, for example a DNA sequence encoding a functional RNA, peptide, polypeptide or protein. Typically the coding sequence is cDNA for the transgene that encodes the functional RNA, peptide, polypeptide or protein of interest. Functional RNA, peptides, polypeptide and proteins of interest are described below.

Clearly the virus genome contains coding sequences of DNA. Endogenous (naturally occurring genes) in the genomic sequence of the virus are not considered a transgene, within the context of the present specification unless then have been modified by recombinant techniques such as that they are in a non-natural location or in a non-natural environment.

In one embodiment transgene as employed herein refers to a segment of DNA containing a gene or cDNA sequence that has been isolated from one organism and is introduced into a different organism i.e. the virus of the present disclosure. In one embodiment this non-native segment of DNA may retain the ability to produce functional RNA, peptide, polypeptide or protein.

Thus in one embodiment the transgene inserted encodes a human or humanised protein, polypeptide or peptide.

In one embodiment the transgene inserted encodes a non-human protein, polypeptide or peptide (such as a non-human mammalian protein, polypeptide or peptide) or RNA molecule, for example from a mouse, rat, rabbit, camel, llama or similar. Advantageously, the viruses of the present disclosure allow the transgenes to be transported inside the cancerous cell. Thus, responses generated by the human patient to a non-human sequence (such as a protein) can be minimised by this intra-cellular deliver A DNA sequence may comprise more than one transgene, for example, 1, 2, 3 or 4 transgenes, such as 1 or 2.

A transgene cassette may comprise more than one transgene, for example, 1, 2, 3 or 4 transgenes, such as 1 or 2.

In one or more embodiments the cassette is arranged as shown in the one or more of the Figures or the examples.

Transgene cassette as employed herein refers to a DNA sequence encoding one or more transgenes in the form of one or more coding sequences and one or more regulatory elements.

A transgene cassette may encode one or more monocistronic and/or polycistronic mRNA sequences.

In one embodiment the transgene or transgene cassette encodes a monocistronic or polycistronic mRNA, and for example the cassette is suitable for insertion into the adenovirus genome at a location under the control of an endogenous promoter or exogenous promoter or a combination thereof.

Monocistronic mRNA as employed herein refers to an mRNA molecule encoding a single functional RNA, peptide, polypeptide or protein.

In one embodiment the transgene cassette encodes monocistronic mRNA.

In one embodiment the transgene cassette in the context of a cassette encoding monocistronic mRNA means a segment of DNA optionally containing an exogenous promoter (which is a regulatory sequence that will determine where and when the transgene is active) or a splice site (which is a regulatory sequence determining when a mRNA molecule will be cleaved by the spliceosome) a coding sequence (i.e. the transgene), usually derived from the cDNA for the protein of interest, optionally containing a polyA signal sequence and a terminator sequence.

In one embodiment the transgene cassette may encode one or more polycistronic mRNA sequences.

Polycistronic mRNA as employed herein refers to an mRNA molecule encoding two or more functional RNA, peptides or proteins or a combination thereof. In one embodiment the transgene cassette encodes a polycistronic mRNA.

In one embodiment transgene cassette in the context of a cassette encoding polycistronic mRNA includes a segment of DNA optionally containing an exogenous promoter (which is a regulatory sequence that will determine where and when the transgene is active) or a splice site (which is a regulatory sequence determining when a mRNA molecule will be cleaved by the spliceosome) two or more coding sequences (i.e. the transgenes), usually derived from the cDNA for the protein or peptide of interest, for example wherein each coding sequence is separated by either an IRES or a 2A peptide. Following the last coding sequence to be transcribed, the cassette may optionally contain a polyA sequence and a terminator sequence.

In one embodiment the transgene cassette encodes a monocistronic mRNA followed by a polycistronic mRNA. In another embodiment the transgene cassette a polycistronic mRNA followed by a monocistronic mRNA.

In one embodiment the adenovirus is a human adenovirus. "Adenovirus", "serotype" or adenoviral serotype" as employed herein refers to any adenovirus that can be assigned to any of the over 50 currently known adenoviral serotypes, which are classified into subgroups A-F, and further extends to any, as yet, unidentified or unclassified adenoviral serotypes. See, for example, Strauss, "Adenovirus infections in humans," in The Adenoviruses, Ginsberg, ea., Plenum Press, New York, N.Y., pp. 451-596 (1984) and Shenk, "Adenoviridae: The Viruses and Their Replication," in Fields Virology, Vol.2, Fourth Edition, Knipe, 35ea., Lippincott Williams & Wilkins, pp. 2265-2267 (2001), as shown in Table 1.

| SubGroup | Adenoviral Serotype |
|---|---|
| A | 12, 18, 31 |
| B | 3, 7, 11, 14, 16, 21, 34, 35, 51 |
| C | 1, 2, 5, 6 |
| D | 8-10, 13, 15, 17, 19, 20, 22-30, 32, 33, 36-39, 42-4950 |
| E | 4 |
| F | 40, 41 |

In one embodiment the adenovirus is a subgroup B, for example independently selected from the group comprising or consisting of: Ad3, Ad7, Ad11, Ad14, Ad16, Ad21, Ad34 and Ad51, such as Ad11, in particular Ad11p (the Slobitski strain). In one embodiment the adenovirus of the invention has the capsid, such as the hexon and/or fibre of a subgroup B adenovirus, such as Ad11, in particular Ad11p. In one embodiment the adenovirus is Ad11 or has the fibre and/or hexon and/or penton of Ad11, such as Ad11p.

In one embodiment it is not a group A virus

In one embodiment the adenovirus is not a group C virus. In one embodiment the adenovirus is not Ad5. Ad5 as employed herein refers to known adenoviruses designated as serotype 5, it does not extend to genetically engineered viruses that comprises sequences from Ad5. In one embodiment viruses of the present disclosure does not have an Ad5 capsid.

In one embodiment the adenovirus of the present disclosure is chimeric. When an adenovirus is chimeric then the characteristics of the outer capsid will be employed to determine the serotype. Chimeric as employed herein refers to a virus that comprises DNA from at least two different virus serotypes, including different serotypes within the same group.

In one embodiment the oncolytic virus has a fibre, hexon and penton proteins from the same serotype, for example Ad11, in particular Ad11p, for example found at positions 30812-31789, 18254-21100 and 13682-15367 of the genomic sequence of the latter wherein the nucleotide positions are relative to genbank ID 217307399 (accession number: GC689208).

In one embodiment the adenovirus is enadenotucirev (also known as EnAd and formerly as EnAd). Enadenotucirev as employed herein refers the chimeric adenovirus of SEQ ID NO: 12. It is a replication competent oncolytic chimeric adenovirus which has enhanced therapeutic properties compared to wild type adenoviruses (see WO2005/118825). EnAd has a chimeric E2B region, which features DNA from Ad11p and Ad3, and deletions in E3/E4. The structural changes in enadenotucirev result in a genome that is approximately 3.5 kb smaller than Ad11p thereby providing additional "space" for the insertion of transgenes.

OvAd1 and OvAd2 are also chimeric adenoviruses similar to enadenotucirev, which also have additional "space" in the genome (see WO2008/080003). Thus in one embodiment the adenovirus is OvAd1 or OvAd2.

In one embodiment the adenovirus is oncolytic. Oncolytic adenovirus as employed herein means an adenovirus that preferentially kills cancer cells as compared with non-cancer cells.

In one embodiment the oncolytic virus is apoptotic. That is, it hastens programmed cell death.

In one embodiment the oncolytic virus is cytolytic. The cytolytic activity of oncolytic adenoviruses of the disclosure can be determined in representative tumour cell lines and the data converted to a measurement of potency, for example with an adenovirus belonging to subgroup C, such as Ad5, being used as a standard (i.e. given a potency of 1). A suitable method for determining cytolytic activity is an MTS assay (see Example 4, FIG. 2 of WO2005/118825 incorporated herein by reference).

In one embodiment the oncolytic virus is necrolytic. That is, it causes or hastens cell necrosis or immunogenic cell death. In one embodiment necrolytic cell death is advantageous because it triggers, induces the patients (host) immune responses.

Unless the context indicates otherwise, adenovirus as employed herein refers to a replication competent virus and also replication deficient viral vectors.

In one embodiment the virus is replication competent. Replication competent in the context of the present specification refers to a virus that possesses all the necessary machinery to replicate in cells in vitro and in vivo, i.e. without the assistance of a packaging cell line. A viral vector, for example deleted in the E1 region, capable of replicating in a complementary packaging cell line is not a replication competent virus in the present context.

Viral vectors are replication deficient and require a packaging cell to provide a complementary gene to allow replication.

Adenovirus genome as employed herein means the DNA sequence encoding the structural proteins and elements relevant to the function/life cycle of an adenovirus.

All human adenovirus genomes examined to date have the same general organisation i.e., the genes encoding specific functions are located at the same position in the viral genome (referred to herein as structural elements). Each end of the viral genome has a short sequence known as the inverted terminal repeat (or ITR), which is required for viral replication. The viral genome contains five early transcription units (E1A, E1B, E2, E3, and E4), three delayed early units (IX, IVa2 and E2 late) and one late unit (major late) that is processed to generate five families of late mRNAs (L1-L5). Proteins encoded by the early genes are primarily involved in replication and modulation of the host cell response to infection, whereas the late genes encode viral structural proteins. Early genes are prefixed by the letter E and the late genes are prefixed by the letter L.

The genome of adenoviruses is tightly packed, that is, there is little non-coding sequence, and therefore it can be difficult to find a suitable location to insert transgenes. The present inventors have identified two DNA regions where transgenes are tolerated, in particular the sites identified are suitable for accommodating complicated transgenes, such as those encoding antibodies. That is, the transgene is expressed without adversely affecting the virus' viability, native properties such as oncolytic properties or replication.

In one embodiment the oncolytic or partial oncolytic virus according to the disclosure may be as a result of deletion in the E4 and/or E3 region, for example deleted in part of the E4 region or fully deleted in the E3 region, or alternatively deleted in part of the E4 region (such as E4orf4) and fully deleted in the E3 region, for example as exemplified in the sequences disclosed herein.

In one embodiment the oncolytic virus of the disclosure is chimeric. Chimeric as employed herein refers to virus that comprises DNA from two or more different serotypes and has oncolytic virus properties.

In one embodiment the oncolytic virus is EnAd or an active derivate thereof which retains the essential beneficial properties of the virus. EnAd is disclosed in WO2005/118825 (incorporated herein by reference) and the full sequence for the virus is provided herein SEQ ID NO: 12. The chimeric E2B region is disclosed herein as SEQ ID NO: 47.

Alternative oncolytic viruses include OvAd1 and OvAd2, which are respectively disclosed as SEQ ID NO: 2 and 3 in WO2008/080003 and incorporated herein by reference.

Advantageously, the adenoviruses of the present disclosure exhibit similar virus activity, for example replication and/or infectivity, profiles to EnAd following infection of a variety of different colon cancer cell lines in vitro.

Structural Elements of Adenoviruses

The present disclosure also relates to the novel sequences of viruses or viral components/constructs, such as plasmids, disclosed herein.

In one embodiment the adenovirus comprises a genome comprising the sequence of formula (I)

$$5'ITR-B_1-B_A-B_2-B_X-B_B-B_Y-B_3-3'ITR \quad (I)$$

wherein: $B_1$ comprises E1A, E1B or E1A-E1B; $B_A$ comprises E2B-L1-L2-L3-E2A-L4; $B_2$ is a bond or comprises E3; $B_X$ is a bond or a DNA sequence comprising a restriction site, one or more transgenes or both; $B_B$ comprises L5; $B_Y$ is a bond or a DNA sequence comprising: a restriction site, one or more transgenes or both; $B_3$ is a bond or comprises E4; wherein at least one of $B_X$ and $B_Y$ is not a bond and comprises a transgene or a restriction site or both.

In one embodiment the adenovirus comprises a genome comprising the sequence of formula (I) wherein $B_1$ comprises E1A, E1B or E1A-E1B; $B_A$ comprises E2B-L1-L2-L3-E2A-L4; $B_2$ is a bond or comprises E3; $B_X$ is a bond; $B_B$ comprises L5; $B_Y$ is a DNA sequence comprising: a restriction site, one or more transgenes or both; $B_3$ is a bond or compromises E4; wherein at least one of $B_X$ and $B_Y$ is not a bond and comprises a transgene or a restriction site or both.

In one embodiment the adenovirus comprises a genome comprising the sequence of formula (I) wherein: $B_1$ comprises E1A, E1B or E1A-E1B; $B_A$ compromises E2B-L1-L2-L3-E2A-L4; $B_2$ is a bond or comprises E3; $B_X$ is a DNA sequence comprising: a restriction site, one or more transgenes or both; $B_B$ is L5; $B_Y$ is a bond; $B_3$ is a bond or comprises E4; wherein at least one of $B_X$ and $B_Y$ is not a bond and comprises a transgene or a restriction site or both.

In one embodiment the adenovirus comprises a genome comprising the sequence of formula (Ia):

$$5'ITR-B_A-B_2-B_X-B_B-B_Y-B_3-3'ITR \quad (Ia)$$

wherein: $B_A$ comprises E2B-L1-L2-L3-E2A-L4; $B_2$ is a bond or comprises E3; $B_X$ is a bond or a DNA sequence comprising a restriction site, one or more transgenes or both; $B_B$ comprises L5; $B_Y$ is a bond or a DNA sequence comprising: a restriction site, one or more transgenes or both; $B_3$ is a bond or comprises E4; wherein at least one of $B_X$ and $B_Y$ is not a bond and at least one comprises a transgene or a restriction site, such as a transgene.

In one embodiment the adenovirus comprises a genome comprising the sequence of formula (Ia) wherein: $B_A$ comprises E2B-L1-L2-L3-E2A-L4; $B_2$ is a bond or comprises E3; $B_X$ is a bond; $B_B$ comprises L5; $B_Y$ is a DNA sequence comprising: a restriction site, one or more transgenes or both; $B_3$ is a bond or comprises E4; wherein at least one of $B_X$ and $B_Y$ is not a bond and at least one comprises a transgene or a restriction site or both, such as a transgene.

In one embodiment the adenovirus comprises a genome comprising the sequence of formula (Ia) wherein $B_A$ comprises E2B-L1-L2-L3-E2A-L4; $B_2$ is a bond or comprises E3; $B_X$ is a DNA sequence comprising: a restriction site, one or more transgenes or both; $B_B$ comprises L5; $B_Y$ is a bond; $B_3$ is a bond or comprises E4; wherein at least one of $B_X$ and $B_Y$ is not a bond and comprises a transgene or restriction site or both, such as a transgene.

In one embodiment the adenovirus comprises a genome comprising the sequence of formula (Ib):

$$5'ITR-B_A-B_X-B_B-B_Y-B_3-3'ITR \quad (Ib)$$

wherein: $B_A$ comprises E2B-L1-L2-L3-E2A-L4; $B_X$ is a bond or a DNA sequence comprising a restriction site, one or more transgenes or both; $B_B$ comprises L5; $B_Y$ is a bond or a DNA sequence comprising: a restriction site, one or more transgenes or both; $B_3$ is a bond or comprises E4; wherein at least one of $B_X$ and $B_Y$ is not a bond and comprises a transgene or a restriction site or both, such as a transgene.

In one embodiment the adenovirus comprises a genome comprising the sequence of formula (Ib) wherein: $B_A$ compromises E2B-L1-L2-L3-E2A-L4; $B_X$ is a bond; $B_B$ compromises L5; $B_Y$ is a DNA sequence comprising: a restriction site, one or more transgenes or both; $B_3$ is a bond or compromises E4; wherein at least one of $B_X$ and $B_Y$ is not a bond and comprises a transgene or a restriction site or both, such as a transgene.

In one embodiment the adenovirus comprises a genome comprising the sequence of formula (Ib) wherein: $B_A$ comprises E2B-L1-L2-L3-E2A-L4; $B_X$ is a DNA sequence comprising: a restriction site, one or more transgenes or both; $B_B$ comprises L5; $B_Y$ is a bond; $B_3$ is a bond or comprises E4; wherein at least one of $B_X$ and $B_Y$ is not a bond and comprises a transgene or a restriction site or both, such as a transgene.

In one embodiment the adenovirus comprises a genome comprising the sequence of formula (Ic):

$$5'TTR-B_A-B_2-B_X-B_B-B_Y-3'TTR \qquad (Ic)$$

wherein: $B_A$ comprises E2B-L1-L2-L3-E2A-L4; $B_2$ is E3; $B_X$ is a bond or a DNA sequence comprising a restriction site, one or more transgenes or both; $B_B$ comprises L5; $B_Y$ is a bond or a DNA sequence comprising: a restriction site, one or more transgenes or both; wherein at least one of $B_X$ and $B_Y$ is not a bond and comprises a transgene or a restriction site or both, such as a transgene.

In one embodiment the adenovirus comprises a genome comprising the sequence of formula (Ic) wherein $B_A$ comprises E2B-L1-L2-L3-E2A-L4; $B_2$ comprises E3; $B_X$ is a bond; $B_B$ comprises L5; $B_Y$ is a DNA sequence comprising: a restriction site, one or more transgenes or both; wherein at least one of $B_X$ and $B_Y$ is not a bond and comprises a transgene or a restriction site or both, such as a transgene.

In one embodiment the adenovirus comprises a genome comprising the sequence of formula (Ic) wherein: $B_A$ comprises E2B-L1-L2-L3-E2A-L4; $B_2$ E3; $B_X$ is a DNA sequence comprising a restriction site, one or more transgenes or both; $B_B$ comprises L5; $B_Y$ is a bond; wherein at least one of $B_X$ and $B_Y$ is not a bond and comprises a transgene or a restriction site, such as a transgene.

In one embodiment the adenovirus comprises a genome comprising the sequence of formula (Id):

$$5'TTR-B_1-B_A-B_X-B_B-B_Y-B_3-3'TTR \qquad (Id)$$

wherein: $B_1$ comprises E1A, E1B or E1A-E1B; $B_A$ comprises E2B-L1-L2-L3-E2A-L4; $B_X$ is a bond or a DNA sequence comprising a restriction site, one or more transgenes or both; $B_B$ comprises L5; $B_Y$ is a bond or a DNA sequence comprising: a restriction site, one or more transgenes or both; $B_3$ is a bond or comprises E4; wherein at least one of $B_X$ and $B_Y$ is not a bond and comprises a transgene a restriction site or both.

In one embodiment the adenovirus comprises a genome comprising the sequence of formula (Id) wherein: $B_1$ comprises E1A, E1B or E1A-E1B; $B_A$ is E2B-L1-L2-L3-E2A-L4; $B_X$ is a bond; $B_B$ comprises L5; $B_Y$ is a DNA sequence comprising: a restriction site, one or more transgenes or both; $B_3$ is a bond or comprises E4; wherein at least one of $B_X$ and $B_Y$ is not a bond and comprises a transgene a restriction site or both, such as a transgene.

In one embodiment the adenovirus comprises a genome comprising the sequence of formula (Id) wherein: $B_1$ comprises E1A, E1B or E1A-E1B; $B_A$ comprises E2B-L1-L2-L3-E2A-L4; $B_X$ is a DNA sequence comprising a restriction site, one or more transgenes or both; $B_B$ comprises L5; $B_Y$ is a bond; $B_3$ is a bond or comprises E4; wherein at least one of $B_X$ and $B_Y$ is not a bond and comprises a transgene a restriction site or both.

In one embodiment the adenovirus comprises a genome comprising the sequence of formula (Ie):

$$5'TTR-B_1-B_A-B_2-B_X-B_B-B_Y-3'TTR \qquad (Ie)$$

wherein: $B_1$ comprises E1A, E1B or E1A-E1B; $B_A$ comprises E2B-L1-L2-L3-E2A-L4; $B_2$ comprises E3; $B_X$ is a bond or a DNA sequence comprising a restriction site, one or more transgenes or both; $B_B$ comprises L5; $B_Y$ is a bond or a DNA sequence comprising: a restriction site, one or more transgenes or both; wherein at least one of $B_X$ and $B_Y$ is not a bond and comprises a transgene a restriction site or both.

In one embodiment the adenovirus comprises a genome comprising the sequence of formula (Ie) wherein: $B_1$ comprises E1A, E1B or E1A-E1B; $B_A$ comprises E2B-L1-L2-L3-E2A-L4; $B_2$ comprises E3; $B_X$ is a bond; $B_B$ comprises L5; $B_Y$ is a DNA sequence comprising: a restriction site, one or more transgenes or both; wherein at least one of $B_X$ and $B_Y$ is not a bond and comprises a transgene a restriction site or both.

In one embodiment the adenovirus comprises a genome comprising the sequence of formula (Ie) wherein $B_1$ comprises E1A, E1B or E1A-E1B; $B_A$ comprises E2B-L1-L2-L3-E2A-L4; $B_2$ comprises E3; $B_X$ is a DNA sequence comprising: a restriction site, one or more transgenes or both; $B_B$ comprises L5; $B_Y$ is a bond; wherein at least one of $B_X$ and $B_Y$ is not a bond and comprises a transgene a restriction site or both.

In one embodiment there is provided a compound of formula (I), (Ia), (Ib), (Ic), (Id) or (Ie) wherein $B_X$ and $B_Y$ is not a bond and comprises a transgene a restriction site or both, such as $B_X$ and $B_Y$ are both a transgene.

A bond refers to a co-valent bond connecting the one DNA sequence to another DNA sequence, for example connecting one section of the virus genome one to another. Thus when a variable in formula (I) (Ia), (Ib), (Ic), (Id) or (Ie) herein represents a bond the feature or element represented by the bond is absent i.e. deleted.

As the structure of adenoviruses is, in general, similar the elements below are discussed in terms of the structural elements and the commonly used nomenclature referring thereto, which are known to the skilled person. When an element is referred to herein then we refer to the DNA sequence encoding the element or a DNA sequence encoding the same structural protein of the element in an adenovirus. The latter is relevant because of the redundancy of the DNA code. The viruses' preference for codon usage may need to be considered for optimised results.

Any structural element from an adenovirus employed in the viruses of the present disclosure may comprise or consist of the natural sequence or may have similarity over the given length of at least 95%, such as 96%, 97%, 98%, 99% or 100%. The original sequence may be modified to omit 10%, 9%, 8%, 7%, 6%, 5%, 4%, 3%, 2% or 1% of the genetic material. The skilled person is aware that when making changes the reading frames of the virus must be not disrupted such that the expression of structural proteins is disrupted.

In one embodiment the given element is a full-length sequence i.e. the full-length gene.

In one embodiment the given element is less than a full-length and retains the same or corresponding function as the full-length sequence.

In one embodiment for a given element which is optional in the constructs of the present disclosure, the DNA sequence may be less than a full-length and have no functionality.

The structural genes encoding structural or functional proteins of the adenovirus are generally linked by non-coding regions of DNA. Thus there is some flexibility about where to "cut" the genomic sequence of the structural element of interest (especially non-coding regions thereof) for the purpose of inserting a transgene into the viruses of the present disclosure. Thus for the purposes of the present specification, the element will be considered a structural element of reference to the extent that it is fit for purpose and does not encode extraneous material. Thus, if appropriate the gene will be associated with suitable non-coding regions, for example as found in the natural structure of the virus.

Thus in one embodiment an insert, such as DNA encoding a restriction site and/or transgene, is inserted into a non-coding region of genomic virus DNA, such as an intron or intergenic sequence. Having said this some non-coding regions of adenovirus may have a function, for example in alternative splicing, transcription regulation or translation regulation, and this may need to be taken into consideration.

The sites identified herein, that are associated with the L5 region, are suitable for accommodating a variety of DNA sequences encoding complex entities such as RNAi, cytokines, single chain or multimeric proteins, such as antibodies.

Gene as employed herein refers to coding and any non-coding sequences associated therewith, for example introns and associated exons. In one embodiment a gene comprises or consists of only essential structural components, for example coding region.

Below follows a discussion relating to specific structural elements of adenoviruses.

The Inverted Terminal Repeat (ITR) sequences are common to all known adenoviruses and were so named because of their symmetry, and are the viral chromosome origins of replication. Another property of these sequences is their ability to form a hairpin.

The 5'ITR as employed herein refers to part or all of an ITR from the 5' end of an adenovirus, which retains the function of the ITR when incorporated into an adenovirus in an appropriate location. In one embodiment the 5'ITR comprises or consists of the sequence from about 1 bp to 138 bp of SEQ ID NO: 12 or a sequence 90, 95, 96, 97, 98 or 99% identical thereto along the whole length, in particular the sequence consisting of from about 1 bp to 138 bp of SEQ ID NO: 12.

The 3'ITR as employed herein refers to part or all of an ITR from 3' end of an adenovirus which retains the function of the ITR when incorporated into an adenovirus in an appropriate location. In one embodiment the 3'ITR comprises or consists of the sequence from about 32189 bp to 32326 bp of SEQ ID NO: 12 or a sequence 90, 95, 96, 97, 98 or 99% identical thereto along the whole length, in particular the sequence consisting of from about 32189 bp to 32326 bp of SEQ ID NO: 12.

$B_1$ as employed herein refers to the DNA sequence encoding: part or all of an E1A from an adenovirus, part or all of the E1B region of an adenovirus, and independently part or all of E1A and E1B region of an adenovirus.

When $B_1$ is a bond then E1A and E1B sequences will be omitted from the virus. In one embodiment $B_1$ is a bond and thus the virus is a vector.

In one embodiment $B_1$ further comprises a transgene. It is known in the art that the E1 region can accommodate a transgene which may be inserted in a disruptive way into the E1 region (i.e. in the "middle" of the sequence) or part or all of the E1 region may be deleted to provide more room to accommodate genetic material.

E1A as employed herein refers to the DNA sequence encoding part or all of an adenovirus E1A region. The latter here is referring to the polypeptide/protein E1A. It may be mutated such that the protein encoded by the E1A gene has conservative or non-conservative amino acid changes, such that it has: the same function as wild-type (i.e. the corresponding non-mutated protein); increased function in comparison to wild-type protein; decreased function, such as no function in comparison to wild-type protein; or has a new function in comparison to wild-type protein or a combination of the same as appropriate.

E1B as employed herein refers to the DNA sequence encoding part or all of an adenovirus E1B region (i.e. polypeptide or protein), it may be mutated such that the protein encoded by the E1B gene/region has conservative or non-conservative amino acid changes, such that it has: the same function as wild-type (i.e. the corresponding non-mutated protein); increased function in comparison to wild-type protein; decreased function, such as no function in comparison to wild-type protein; or has a new function in comparison to wild-type protein or a combination of the same as appropriate.

Thus $B_1$ can be modified or unmodified relative to a wild-type E1 region, such as a wild-type E1A and/or E1B. The skilled person can easily identify whether E1A and/or E1B are present or (part) deleted or mutated.

Wild-type as employed herein refers to a known adenovirus. A known adenovirus is one that has been identified and named, regardless of whether the sequence is available.

In one embodiment $B_1$ has the sequence from 139 bp to 3932 bp of SEQ ID NO: 12.

$B_A$ as employed herein refers to the DNA sequence encoding the E2B-L1-L2-L3-E2A-L4 regions including any non-coding sequences, as appropriate. Generally this sequence will not comprise a transgene. In one embodiment the sequence is substantially similar or identical to a contiguous sequence from a known adenovirus, for example a serotype shown in Table 1, in particular a group B virus, for example Ad3, Ad7, Ad11, Ad14, Ad16, Ad21, Ad34, Ad35, Ad51 or a combination thereof, such as Ad3, Ad11 or a combination thereof. In one embodiment is E2B-L1-L2-L3-E2A-L4 refers to comprising these elements and other structural elements associated with the region, for example $B_A$ will generally include the sequence encoding the protein IV2a, for example as follows: IV2A IV2a-E2B-L1-L2-L3-E2A-L4

In one embodiment the E2B region is chimeric. That is, comprises DNA sequences from two or more different adenoviral serotypes, for example from Ad3 and Ad11, such as Ad11p. In one embodiment the E2B region has the sequence from 5068 bp to 10355 bp of SEQ ID NO: 12 or a sequence 95%, 96%, 97%, 98% or 99% identical thereto over the whole length.

In one embodiment the E2B in component $B_A$ comprises the sequences shown in SEQ ID NO: 47 (which corresponds to SEQ ID NO: 3 disclosed in WO2005/118825).

In one embodiment $B_A$ has the sequence from 3933 bp to 27184 bp of SEQ ID NO: 12.

E3 as employed herein refers to the DNA sequence encoding part or all of an adenovirus E3 region (i.e. protein/polypeptide), it may be mutated such that the protein encoded by the E3 gene has conservative or non-conservative amino acid changes, such that it has the same function as wild-type (the corresponding unmutated protein); increased function in comparison to wild-type protein; decreased function, such as no function in comparison to wild-type protein or has a new function in comparison to wild-type protein or a combination of the same, as appropriate.

In one embodiment the E3 region is form an adenovirus serotype given in Table 1 or a combination thereof, in particular a group B serotype, for example Ad3, Ad7, Ad11 (in particular Ad11p), Ad14, Ad16, Ad21, Ad34, Ad35, Ad51 or a combination thereof, such as Ad3, Ad11 (in particular Ad11p) or a combination thereof.

In one embodiment the E3 region is partially deleted, for example is 95%, 90%, 85%, 80%, 75%, 70%, 65%, 60%, 55%, 50%, 45%, 40%, 35%, 30%, 25%, 20%, 15%, 10%, 5% deleted. In one embodiment $B_2$ is a bond, wherein the DNA encoding the E3 region is absent.

In one embodiment the DNA encoding the E3 region can be replaced or interrupted by a transgene. As employed herein "E3 region replaced by a transgene as employed herein includes part or all of the E3 region is replaced with a transgene.

In one embodiment the $B_2$ region comprises the sequence from 27185 bp to 28165 bp of SEQ ID NO: 12.

In one embodiment $B_2$ consists of the sequence from 27185 bp to 28165 bp of SEQ ID NO: 12.

$B_X$ as employed herein refers to the DNA sequence in the vicinity of the 5' end of the L5 gene in $B_B$. In the vicinity of or proximal to the 5' end of the L5 gene as employed herein refers to: adjacent (contiguous) to the 5' end of the L5 gene or a non-coding region inherently associated herewith i.e. abutting or contiguous to the 5' prime end of the L5 gene or a non-coding region inherently associated therewith. Alternatively, in the vicinity of or proximal to may refer to being close the L5 gene, such that there are no coding sequences between the $B_X$ region and the 5' end of L5 gene.

Thus in one embodiment $B_X$ is joined directly to a base of L5 which represents, for example the start of a coding sequence of the L5 gene.

Thus in one embodiment $B_X$ is joined directly to a base of L5 which represents, for example the start of a non-coding sequence, or joined directly to a non-coding region naturally associated with L5. A non-coding region naturally associated L5 as employed herein refers to part of all of a non-coding regions which is part of the L5 gene or contiguous therewith but not part of another gene.

In one embodiment $B_X$ comprises the sequence of SEQ ID NO: 10. This sequence is an artificial non-coding sequence wherein a DNA sequence, for example comprising a transgene (or transgene cassette), a restriction site or a combination thereof may be inserted therein. This sequence is advantageous because it acts as a buffer in that allows some flexibility on the exact location of the transgene whilst minimising the disruptive effects on virus stability and viability.

The insert(s) can occur anywhere within SEQ ID NO: 10 from the 5' end, the 3' end or at any point between bp 1 to 201, for example between base pairs 1/2, 2/3, 3/4, 4/5, 5/6, 6/7, 7/8, 8/9, 9/10, 10/11, 11/12, 12/13, 13/14, 14/15, 15/16, 16/17, 17/18, 18/19, 19/20, 20/21, 21/22, 22/23, 23/24, 24/25, 25/26, 26/27, 27/28, 28/29, 29/30, 30/31, 31/32, 32/33, 33/34, 34/35, 35/36, 36/37, 37/38, 38/39, 39/40, 40/41, 41/42, 42/43, 43/44, 44/45, 45/46, 46/47, 47/48, 48/49, 49/50, 50/51, 51/52, 52/53, 53/54, 54/55, 55/56, 56/57, 57/58, 58/59, 59/60, 60/61, 61/62, 62/63, 63/64, 64/65, 65/66, 66/67, 67/68, 68/69, 69/70, 70/71, 71/72, 72/73, 73/74, 74/75, 75/76, 76/77, 77/78, 78/79, 79/80, 80/81, 81/82, 82/83, 83/84, 84/85, 85/86, 86/87, 87/88, 88/89, 89/90, 90/91, 91/92, 92/93, 93/94, 94/95, 95/96, 96/97, 97/98, 98/99, 99/100, 100/101, 101/102, 102/103, 103/104, 104/105, 105/106, 106/107, 107/108, 108/109, 109/110, 110/111, 111/112, 112/113, 113/114, 114/115, 115/116, 116/117, 117/118, 118/119, 119/120, 120/121, 121/122, 122/123, 123/124, 124/125, 125/126, 126/127, 127/128, 128/129, 129/130, 130/131, 131/132, 132/133, 133/134, 134/135, 135/136, 136/137, 137/138, 138/139, 139/140, 140/141, 141/142, 142/143, 143/144, 144/145, 145/146, 146/147, 147/148, 148/149, 150/151, 151/152, 152/153, 153/154, 154/155, 155/156, 156/157, 157/158, 158/159, 159/160, 160/161, 161/162, 162/163, 163/164, 164/165, 165/166, 166/167, 167/168, 168/169, 169/170, 170/171, 171/172, 172/173, 173/174, 174/175, 175/176, 176/177, 177/178, 178/179, 179/180, 180/181, 181/182, 182/183, 183/184, 184/185, 185/186, 186/187, 187/188, 189/190, 190/191, 191/192, 192/193, 193/194, 194/195, 195/196, 196/197, 197/198, 198/199, 199/200 or 200/201.

In one embodiment $B_X$ comprises SEQ ID NO: 10 with a DNA sequence inserted between bp 27 and bp 28 or a place corresponding to between positions 28192 bp and 28193 bp of SEQ ID NO: 12.

In one embodiment the insert is a restriction site insert. In one embodiment the restriction site insert comprises one or two restriction sites. In one embodiment the restriction site is a 19 bp restriction site insert comprising 2 restriction sites. In one embodiment the restriction site insert is a 9 bp restriction site insert comprising 1 restriction site. In one embodiment the restriction site insert comprises one or two restriction sites and at least one transgene, for example one or two transgenes. In one embodiment the restriction site is a 19 bp restriction site insert comprising 2 restriction sites and at least one transgene, for example one or two transgenes. In one embodiment the restriction site insert is a 9 bp restriction site insert comprising 1 restriction site and at least one transgene, for example one, two or three transgenes, such as one or two. In one embodiment two restriction sites sandwich one or more, such as two transgenes (for example in a transgene cassette). In one embodiment when $B_X$ comprises two restrictions sites the said restriction sites are different from each other. In one embodiment said one or more restrictions sites in $B_X$ are non-naturally occurring in the particular adenovirus genome into which they have been inserted. In one embodiment said one or more restrictions sites in $B_X$ are different to other restrictions sites located elsewhere in the adenovirus genome, for example different to naturally occurring restrictions sites and/or restriction sites introduced into other parts of the genome, such as a restriction site introduced into $B_Y$. Thus in one embodiment the restriction site or sites allow the DNA in the section to be cut specifically.

Advantageously, use of "unique" restriction sites provides selectivity and control over the where the virus genome is cut, simply by using the appropriate restriction enzyme.

Cut specifically as employed herein refers to where use of an enzyme specific to the restriction sites cuts the virus only in the desired location, usually one location, although occasionally it may be a pair of locations. A pair of locations as employed herein refers to two restrictions sites in proximity of each other that are designed to be cut by the same enzyme (i.e. cannot be differentiated from each other).

In one embodiment the restriction site insert is SEQ ID NO: 55.

In one embodiment $B_X$ has the sequence from 28166 bp to 28366 bp of SEQ ID NO: 12.

In one embodiment $B_X$ is a bond.

$B_B$ as employed herein refers to the DNA sequence encoding the L5 region. As employed herein the L5 region refers to the DNA sequence containing the gene encoding the fibre polypeptide/protein, as appropriate in the context. The fibre gene/region encodes the fibre protein which is a major capsid component of adenoviruses. The fibre functions in receptor recognition and contributes to the adenovirus' ability to selectively bind and infect cells.

In viruses of the present disclosure the fibre can be from any adenovirus serotype and adenoviruses which are chimeric as result of changing the fibre for one of a different serotype are known. In one embodiment the fibre is from a group B virus, in particular Ad11, such as Ad11p. In one embodiment $B_B$ has the sequence from 28367 bp to 29344 bp of SEQ ID NO: 12.

DNA sequence in relation to $B_Y$ as employed herein refers to the DNA sequence in the vicinity of the 3' end of the L5 gene of $B_B$. In the vicinity of or proximal to the 3' end of the L5 gene as employed herein refers to: adjacent (contiguous) to the 3' end of the L5 gene or a non-coding region inherently associated therewith i.e. abutting or contiguous to the 3' prime end of the L5 gene or a non-coding region inherently associated therewith (i.e. all or part of an non-coding sequence endogenous to L5). Alternatively, in the vicinity of or proximal to may refer to being close the L5 gene, such that there are no coding sequences between the $B_Y$ region and the 3' end of the L5 gene.

Thus in one embodiment $B_Y$ is joined directly to a base of L5 which represents the "end" of a coding sequence.

Thus in one embodiment $B_Y$ is joined directly to a base of L5 which represents the "end" of a non-coding sequence, or joined directly to a non-coding region naturally associated with L5.

Inherently and naturally are used interchangeably herein. In one embodiment $B_Y$ comprises the sequence of SEQ ID NO: 11. This sequence is a non-coding sequence wherein a DNA sequence, for example comprising a transgene (or transgene cassette), a restriction site or a combination thereof may be inserted. This sequence is advantageous because it acts a buffer in that allows some flexibility on the exact location of the transgene whilst minimising the disruptive effects on virus stability and viability.

The insert(s) can occur anywhere within SEQ ID NO: 11 from the 5' end, the 3' end or at any point between bp 1 to 35, for example between base pairs 1/2, 2/3, 3/4, 4/5, 5/6, 6/7, 7/8, 8/9, 9/10, 10/11, 11/12, 12/13, 13/14, 14/15, 15/16, 16/17, 17/18, 18/19, 19/20, 20/21, 21/22, 22/23, 23/24, 24/25, 25/26, 26/27, 27/28, 28/29, 29/30, 30/31, 31/32, 32/33, 33/34, or 34/35.

In one embodiment $B_Y$ comprises SEQ ID NO: 11 with a DNA sequence inserted between positions bp 12 and 13 or a place corresponding to 29356 bp and 29357 bp in SEQ ID NO: 12. In one embodiment the insert is a restriction site insert. In one embodiment the restriction site insert comprises one or two restriction sites. In one embodiment the restriction site is a 19 bp restriction site insert comprising 2 restriction sites. In one embodiment the restriction site insert is a 9 bp restriction site insert comprising 1 restriction site. In one embodiment the restriction site insert comprises one or two restriction sites and at least one transgene, for example one or two or three transgenes, such as one or two transgenes. In one embodiment the restriction site is a 19 bp restriction site insert comprising 2 restriction sites and at least one transgene, for example one or two transgenes. In one embodiment the restriction site insert is a 9 bp restriction site insert comprising 1 restriction site and at least one transgene, for example one or two transgenes. In one embodiment two restriction sites sandwich one or more, such as two transgenes (for example in a transgene cassette). In one embodiment when $B_Y$ comprises two restrictions sites the said restriction sites are different from each other. In one embodiment said one or more restrictions sites in $B_Y$ are non-naturally occurring (such as unique) in the particular adenovirus genome into which they have been inserted. In one embodiment said one or more restrictions sites in $B_Y$ are different to other restrictions sites located elsewhere in the adenovirus genome, for example different to naturally occurring restrictions sites or restriction sites introduced into other parts of the genome, such as $B_X$. Thus in one embodiment the restriction site or sites allow the DNA in the section to be cut specifically.

In one embodiment the restriction site insert is SEQ ID NO: 54.

In one embodiment $B_Y$ has the sequence from 29345 bp to 29379 bp of SEQ ID NO: 12.

In one embodiment $B_Y$ is a bond.

In one embodiment the insert is after bp 12 in SEQ ID NO: 11.

In one embodiment the insert is at about position 29356 bp of SEQ ID NO: 12.

In one embodiment the insert is a transgene cassette comprising one or more transgenes, for example 1, 2 or 3, such as 1 or 2.

E4 as employed herein refers to the DNA sequence encoding part or all of an adenovirus E4 region (i.e. polypeptide/protein region), which may be mutated such that the protein encoded by the E4 gene has conservative or non-conservative amino acid changes, and has the same function as wild-type (the corresponding non-mutated protein); increased function in comparison to wild-type protein; decreased function, such as no function in comparison to wild-type protein or has a new function in comparison to wild-type protein or a combination of the same as appropriate.

In one embodiment the E4 region is partially deleted, for example is 95%, 90%, 85%, 80%, 75%, 70%, 65%, 60%, 55%, 50%, 45%, 40%, 35%, 30%, 25%, 20%, 15%, 10% or 5% deleted. In one embodiment the E4 region has the sequence from 32188 bp to 29380 bp of SEQ ID NO: 12.

In one embodiment $B_3$ is a bond, i.e. wherein E4 is absent.

In one embodiment $B_3$ has the sequence consisting of from 32188 bp to 29380 bp of SEQ ID NO: 12.

As employed herein number ranges are inclusive of the end points.

The skilled person will appreciate that the elements in the formulas herein, such as formula (I), (Ia), (Ib), (Ic), (Id) and (Ie) are contiguous and may embody non-coding DNA sequences as well as the genes and coding DNA sequences (structural features) mentioned herein. In one or more embodiments the formulas of the present disclosure are attempting to describe a naturally occurring sequence in the adenovirus genome. In this context it will be clear to the skilled person that the formula is referring to the major elements characterising the relevant section of genome and is not intended to be an exhaustive description of the genomic stretch of DNA.

E1A, E1B, E3 and E4 as employed herein each independently refer to the wild-type and equivalents thereof, mutated or partially deleted forms of each region as described herein, in particular a wild-type sequence from a known adenovirus.

"Insert" as employed herein refers to a DNA sequence that is incorporated either at the 5' end, the 3' end or within a given DNA sequence reference segment such that it interrupts the reference sequence. The latter is a reference sequence employed as a reference point relative to which the insert is located. In the context of the present disclosure inserts generally occur within either SEQ ID NO: 10 or SEQ ID NO: 11. An insert can be either a restriction site insert, a transgene cassette or both. When the sequence is interrupted the virus will still comprise the original sequence, but generally it will be as two fragments sandwiching the insert.

In one embodiment the transgene or transgene cassette does not comprise a non-biased inserting transposon, such as a TN7 transposon or part thereof. Tn7 transposon as employed herein refers to a non-biased insertion transposon as described in WO2008/080003.

Restriction Sites

Restriction sites in the locations disclosed here (for example in $B_X$ and/or $B_Y$) are useful in viruses and constructs of the present disclosure, such as plasmids, because they allow the transgene to be changed rapidly and, for example selectively when the restriction sites around the transgene(s) are unique.

Unique as employed herein refers to only one occurrence in the whole of the virus or construct.

In one embodiment the transgene or transgene cassette comprises a restriction site at each terminus, thereby allowing the cassette to be replaced.

A restriction site is a location in a DNA sequence that can be cut by a restriction enzyme, usually an enzyme specific to the sequence. In one embodiment the restriction site comprises 3 to 22 base pairs, for example 4 to 22, such as 5, 6, 7, 8, 9, 10, 11, 12, 13, 14, 15, 16, 17, 18, 19, 20, 21 or 22 base pairs. Examples of restriction sites cut by restriction enzymes include but are not limited to:

sequence GCGGCCGC cut by NotI and CcuNI leaving 5'-GGCC overhangs sequence GGCCGGCC cut by FseI and RigI leaving 3'-CCGG overhangs sequence GCGATCGC cut by AsiSI, RgaI, SgfI and SfaAI leaving 3'-AT overhangs sequence CCTGCAGG cut by SbfI, SdaI and Sse83871 leaving 3'-TGCA overhangs sequence TGATCA cut by BclI, FbaI, Ksp221 and BsiQ1 leaving 5'-GATC overhangs sequence CAAAACGTCGTGAGACAGTTTG [SEQ ID NO: 74] cut by I-CreI leaving 3'-GTGA overhangs sequence TAACTATAACGGTCCTAAGGTAGCGAA [SEQ ID NO: 75] cut by I-CeuI leaving 3' CTAA overhangs sequence TAGGGATAACAGGGTAAT [SEQ ID NO: 76] cut by I-SceI leaving 3' ATAA overhangs sequence GCCCGGGC cut by SrfI leaving blunt ends sequence GTTTAAAC cut by MssI, PmeI leaving blunt ends sequence ATTTAAAT cut by SwaI, SmiI leaving blunt ends sequence GGCGCGCC cut by AscI, PalAI and SgsI leaving 5' CGCG overhangs Other restriction enzymes that cut the same recognition sites may also be suitable.

In one embodiment one or more restrictions sites in $B_X$ and $B_Y$ are independently selected from a restriction site specific to an enzyme described herein, for example NotI, FseI, AsiSI, SgfI and SbfI, in particular the restriction sites inserted are all different, such as sites specific for NotI and sites specific for FseI located in $B_X$ and SgfI and SbfI located in $B_Y$.

As discussed above in one embodiment the region $B_X$ and/or $B_Y$ do not comprise a restriction site. Advantageously, the viruses and constructs of the present disclosure can be prepared without restriction sites, for example using synthetic techniques. These techniques allow a great flexibility in the creation of the viruses and constructs. Furthermore, the present inventors have established that the properties of the viruses and constructs are not diminished when they are prepared by synthetic techniques.

Promoters

Promoter as employed herein means a region of DNA that initiates transcription of a particular gene or genes. Promoters are generally located proximal to the genes they transcribe, on the same strand and upstream (i.e. 5') on the DNA. Proximal as employed in this context means sufficiently close to function as a promoter. In one embodiment the promoter is within 100 bp of the transcription start site. Thus endogenous promoter as employed herein refers to a promoter that naturally occurs in (i.e. is native to) the adenovirus (or construct) into which the transgene, is being inserted. In one or more embodiments the endogenous promoter employed is the naturally occurring promoter in the virus in its original location in the virus genome, in particular this is the primary or only promoter employed in the expression of the transgene or transgenes. In one embodiment the endogenous promoter used to promote the translation and optionally the transcription of the transgene is one resident, i.e. is one integrated in the genome of the adenovirus and not previously introduced by recombinant techniques.

Under the control of an endogenous promoter as employed herein refers to where the transgene/transgene cassette is inserted in the appropriate orientation to be under the control of said endogenous promoter. That is, where the promoter is generally on the antisense strand, the cassette is inserted, for example in the antisense orientation.

Having said this, genes can be expressed in one of two orientations. However, generally one orientation provides increased levels of expression over the other orientation, for a given (particular) transgene.

In one embodiment the cassette is in the sense orientation. That is, is transcribed in a 5' to 3' direction. In one embodiment the cassette is in the antisense orientation. That is, transcribed in the 3' to 5' orientation.

The endogenous promoters in the virus can, for example, be utilised by employing a gene encoding a transgene and a splice acceptor sequence. Thus in one embodiment the cassette will comprise a splice acceptor sequence when under the control of an endogenous promoter. Thus in one embodiment the coding sequence, for example the sequence encoding the antibody or antibody binding fragment further comprises a splice acceptor sequence.

In one embodiment the transgene, transgenes, or transgene cassette are under the control of an E4 promoter or a major late promoter, such as the major late promoter (ML promoter).

Under the control of as employed herein means that the transgene is activated, i.e. transcribed, when a particular promoter dictates.

The Major Late Promoter (ML promoter or MLP) as employed herein refers to the adenovirus promoter that controls expression of the "late expressed" genes, such as the L5 gene. The MLP is a "sense strand" promoter. That is, the promoter influences genes that are downstream of the promoter in the 5'-3' direction. The major late promoter as employed herein refers the original major late promoter located in the virus genome.

E4 promoter as employed herein refers to the adenovirus promoter of the E4 region. The E4 region is an antisense region; therefore the promoter is an antisense promoter. That is, the promoter is upstream of the E4 region in the 3'-5' direction. Therefore any transgene cassette under control of the E4 promoter may need to be oriented appropriately. In one embodiment the cassette under the control of the E4 promoter is in the antisense orientation. In one embodiment the cassette is under the control of the E4 promoter in the sense orientation. The E4 promoter as employed herein refers to the original E4 promoter located in the virus genome.

Thus in one embodiment there is provided a replication competent oncolytic adenovirus serotype 11 (such as Ad11p) or virus-derivative thereof wherein the fibre, hexon and capsid are serotype 11 (such as Ad11p), wherein the virus genome comprises a DNA sequence encoding a therapeutic antibody or antibody-binding fragment, wherein said DNA sequence under the control of a promoter endogenous to the adenovirus selected from consisting of E4 and the major late promoter (i.e. the E4 promoter or the major late promoter), such that the transgene does not interfere with virus replication, for example is associated with the L5 region (i.e. before or after said region), such as located after L5 in the virus genome, for example as shown in SEQ ID NO: 1 to 9, 46, 48 to 53, 56 to 63, 66-69 and 72-73.

In one embodiment an endogenous promoter is introduced into the viral genome at a desired location by recombinant techniques, for example is introduced in the transgene cassette. However, in the context of the present specification this arrangement will generally be referred to as an exogenous promoter.

In one embodiment the transgene cassette comprises an exogenous promoter. Exogenous promoter as employed herein refers to a promoter that is not naturally occurring in the adenovirus into which the transgene is being inserted. Typically exogenous promoters are from other viruses or are mammalian promoters. Exogenous promoter as employed herein means a DNA element, usually located upstream of the gene of interest, that regulates the transcription of the gene.

In one embodiment the regulator of gene expression is an exogenous promoter, for example CMV (cytomegalovirus promoter), CBA (chicken beta actin promoter) or PGK (phosphoglycerate kinase 1 promoter), such as CMV promoter.

In one embodiment the CMV exogenous promoter employed has the nucleotide sequence of SEQ ID NO: 13. In one embodiment the PGK exogenous promoter employed has the nucleotide sequence of SEQ ID NO: 14. In one embodiment the CBA exogenous promoter employed has the nucleotide sequence of SEQ ID NO: 15.

In one embodiment there is provided a replication competent oncolytic adenovirus serotype 11 (such as Ad11p) or virus-derivative thereof wherein the fibre, hexon and capsid are serotype 11 (such as Ad11p), wherein the virus genome comprises a DNA sequence encoding a therapeutic antibody or antibody-binding fragment located in a part of the virus genome which is expressed late in the virus replication cycle and such that the transgene does not interfere with virus replication, wherein said DNA sequence under the control of a promoter exogenous to the adenovirus (for example the CMV promoter). In one embodiment the DNA sequence encoding an antibody or fragment is associated with the L5 region as described elsewhere herein.

In one embodiment the exogenous promoter is an antigen-presenting cell promoter. Antigen-presenting cell promoter as employed herein refers to a promoter for a gene that is selectively expressed by antigen-presenting cells, such as dendritic cells or macrophages. Such genes include but are not limited to: FLT-3, FLT-3 ligand, TLRs, CD1a, CD1c, CD11b, CD11c, CD80, CD83, CD86, CD123, CD172a, CD205, CD207, CD209, CD273, CD281, CD283, CD286, CD289, CD287, CXCR4, GITR Ligand, IFN-α2, IL-12, IL-23, ILT1, ILT2, ILT3, ILT4, ILTS, ILT7, TSLP Receptor, CD141, CD303, CADM1, CLEC9a, XCR1 or CD304; antigen processing and presentation mediators such as CTIIA or GILT. Thus in one embodiment the exogenous promoter is suitable for selective expression of transgenes in said antigen-presenting cells.

Other Regulatory Sequences

"Regulator of gene expression" (or regulator/regulatory element) as employed herein refers to a genetic feature, such as a promoter, enhancer or a splice acceptor sequence that plays a role in gene expression, typically by initiating or enhancing transcription or translation.

"Splice acceptor sequence", "splice acceptor" or "splice site" as employed herein refers to a regulatory sequence determining when an mRNA molecule will be recognised by small nuclear ribonucleoproteins of the spliceosome complex. Once assembled the spliceosome catalyses splicing between the splice acceptor site of the mRNA molecule to an upstream splice donor site producing a mature mRNA molecule that can be translated to produce a single polypeptide or protein.

Different sized splice acceptor sequences may be employed in the present invention and these can be described as short splice acceptor (small), splice acceptor (medium) and branched splice acceptor (large).

SSA as employed herein means a short splice acceptor, typically comprising just the splice site, for example 4 bp. SA as employed herein means a splice acceptor, typically comprising the short splice acceptor and the polypyrimidine tract, for example 16 bp. bSA as employed herein means a branched splice acceptor, typically comprising the short splice acceptor, polypyrimidine tract and the branch point, for example 26 bp.

In one embodiment the splice acceptor employed in the constructs of the disclosure are shown in SEQ ID NO: 16 to 18. In one embodiment the SSA has the nucleotide sequence of SEQ ID NO: 16. In one embodiment the SA has the nucleotide sequence of SEQ ID NO: 17. In one embodiment the bSA has the nucleotide sequence of SEQ ID NO: 18. In one embodiment the splice acceptor sequence is independently selected from the group comprising: TGCTAATCTT CCTTTCTCTC TTCAGG (SEQ ID NO: 18), CCTTTCTCTCTT CAGG (SEQ ID NO: 17), and CAGG (SEQ ID NO: 16).

In one embodiment the splice site is immediately proceeded (i.e. followed in a 5' to 3' direction) by a consensus Kozak sequence comprising CCACC. In one embodiment the splice site and the Kozak sequence are interspersed by up to 100 or less bp. In one embodiment the Kozak sequence has the nucleotide sequence of SEQ ID NO: 45.

Typically, when under the control of an endogenous or exogenous promoter (such as an endogenous promoter), the coding sequence will be immediately preceded by a Kozak sequence. The start of the coding region is indicated by the initiation codon (AUG), for example is in the context of the sequence (gcc)gccRccAUGg [SEQ ID NO: 77] the start of the start of the coding sequences is indicated by the bases in bold. A lower case letter denotes common bases at this position (which can nevertheless vary) and upper case letters indicate highly-conserved bases, i.e. the 'AUGG' sequence is constant or rarely, if ever, changes; 'R' indicates that a purine (adenine or guanine) is usually observed at this position and the sequence in brackets (gcc) is of uncertain significance. Thus in one embodiment the initiation codon AUG is incorporated into a Kozak sequence.

Internal Ribosome Entry DNA Sequence as employed herein refers to a DNA sequence encoding an Internal Ribosome Entry Sequence (IRES). IRES as employed herein means a nucleotide sequence that allows for initiation of translation a messenger RNA (mRNA) sequence, including initiation starting within an mRNA sequence. This is particularly useful when the cassette encodes polycistronic mRNA. Using an IRES results in a polycistronic mRNA that is translated into multiple individual proteins or peptides. In one embodiment the Internal Ribosome Entry DNA sequence has the nucleotide sequence of SEQ ID NO: 19. In one embodiment a particular IRES is only used once in the genome. This may have benefits with respect to stability of the genome.

"High self-cleavage efficiency 2A peptide" or "2A peptide" as employed herein refers to a peptide which is efficiently cleaved following translation. Suitable 2A peptides include P2A, F2A, E2A and T2A. The present inventors have noted that once a specific DNA sequence encoding a given 2A peptide is used once, the same specific DNA sequence may not be used a second time. However, redundancy in the DNA code may be utilised to generate a DNA sequence that is translated into the same 2A peptide. Using 2A peptides is particularly useful when the cassette encodes polycistronic mRNA. Using 2A peptides results in a single polypeptide chain being translated which is modified post-translation to generate multiple individual proteins or peptides.

In one embodiment the encoded P2A peptide employed has the amino acid sequence of SEQ ID NO: 25. In one embodiment the encoded F2A peptide employed has the amino acid sequence of SEQ ID NO: 26. In one embodiment the encoded E2A peptide employed has the amino acid sequence of SEQ ID NO: 27. In one embodiment the encoded T2A peptide employed has the amino acid sequence of SEQ ID NO: 28.

In one embodiment an mRNA or each mRNA encoded by transgene is/are comprise a polyadenylation signal sequence, such as typically at the end of an mRNA sequence, for example as shown in SEQ ID NO: 20. Thus one embodiment the transgene or the transgene cassette comprises at least one sequence encoding a polyadenylation signal sequence.

"PolyA", "Polyadenylation signal" or "polyadenylation sequence" as employed herein means a DNA sequence, usually containing an AATAAA site, that once transcribed can be recognised by a multiprotein complex that cleaves and polyadenylates the nascent mRNA molecule.

In one embodiment the polyadenylation sequence has the nucleotide sequence of SEQ ID NO: 20.

In one embodiment the construct does not include a polyadenylation sequence. In one embodiment the regulator of gene expression is a splice acceptor sequence.

In one embodiment the sequence encoding a protein/polypeptide/peptide, such as an antibody or antibody fragment further comprises a polyadenylation signal.

Transgene Encodes

In one embodiment the transgene or transgenes independently encode a protein, peptide, RNA molecule, such as an RNA molecule. Advantageously the transgene can be delivered intra-cellularly and can subsequently be transcribed and if appropriate translated. Examples of genetic material encoded by a transgene include, for example antibodies or binding fragments thereof, chemokines, cytokines, immunmodulators, enzymes (for example capable of converting pro-drug in the active agent) and an RNAi molecule.

Peptide as employed herein refers to an amino acid sequence of 2 to 50 residues, for example 5 to 20 residues. Polypeptide as employed herein refers to an amino acid sequence of more than 50 residues without tertiary structure, in particular without secondary and tertiary structure. Protein refers to an amino acid sequence of more than 50 residues, with secondary and/or tertiary structure, in particular with second and tertiary structure.

In one embodiment the coding sequence encodes a therapeutic RNA, therapeutic peptide, therapeutic polypeptide or therapeutic protein (i.e. is a therapeutic gene).

Therapeutic gene as employed herein means a gene that encodes an entity that may be useful in the treatment, amelioration or prevention of disease, for example the gene expresses a therapeutic protein, polypeptide, peptide or RNA, which at least slows down, halts or reverses the progression of a disease, such as cancer.

In one embodiment the entity encoded by the transgene when transcribed or translated in a cell, such as a cancer cell, increases production of danger signals by the cell. "Danger signals" as employed herein refers to a variety of molecules produced by cells undergoing injury, stress or non-apoptotic death that act as alarm signals, for example by stimulating cells of the innate immune system to respond directly as well as serving to enhance activation of cells of the adaptive immune system.

It is known that the microenvironment of tumours often changes such that natural human immune responses are down regulated. Thus the ability to re-start the immune responses from within the tumour is potentially very interesting in the treatment of cancer.

In one embodiment the encoded therapeutic peptide or protein is designed to be secreted into the extracellular environment. In one embodiment the functional RNA, peptide, polypeptide or protein, such as the antibody is released into the external microenvironment of the cell, for example into the culture supernatant, or in vivo: tissue, stroma, circulation, blood and/or lymphatic system.

In one embodiment the peptide, polypeptide or protein, encoded by the transgene, comprises a signal sequence. Signal peptide as employed herein refers to a short 13-36 residue peptide sequence located at the N-terminal of proteins which assist the entry of the protein into the secretory pathway for secretion or membrane expression. In one embodiment the leader sequence (signal peptide) has the amino acid sequence of SEQ ID NO: 21 or 22.

In another embodiment the encoded therapeutic peptide or protein, such as an antibody is designed to be expressed as a membrane-anchored form in the surface membrane of the cell, for example by including encoding a transmembrane domain in the protein or a site for attachment of a lipid membrane anchor.

In one embodiment the functional RNA, peptide, polypeptide or protein, such as an antibody is released from the cell infected by the adenovirus, for example by active secretion or as a result of cell lysis. Thus in one embodiment the adenovirus lyses the cell, thereby releasing the functional RNA, peptide, polypeptide or protein, such as the antibody.

In another embodiment the encoded therapeutic peptide or protein, such as an antibody is designed to be retained within the intact cell.

Advantageously, functional RNA, peptide, polypeptide or protein, such as antibodies expressed by adenoviruses of the present disclosure can be detected in tissue in vivo as both mRNA (see FIG. 16, FIG. 41C) and antibody protein (see FIG. 17A, FIG. 35B). Furthermore, the expressed functional RNA, peptide or protein, such as the antibody can bind its ligand in ELISA (see FIG. 17B). Yet further, the functional RNA, peptide, polypeptide or protein, such as the antibody is detectable early (within 3 days of infection see FIG. 18B) and the expression is sustained over several weeks (see FIGS. 17 and 18B).

In one embodiment adenoviruses of the present disclosure express functional RNA, peptide, polypeptide or protein, such as antibodies within about 3 days or more of infection, such as within about 36, 48, 60 or 72 hours, or such as 2, 3, 4, 5 or 6 days.

In one embodiment adenoviruses of the present disclosure express functional RNA, peptide, polypeptide or protein, such as antibodies for several weeks, such as about 1, 2, 3, 4, 5 or 6 weeks. Such as 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41 or 42 days.

Advantageously, functional RNA, peptide or protein expression, such as antibody expression is sufficiently high to be able to detect the functional RNA, peptide, polypeptide or protein, such as the antibody in the blood (see FIG. 19, FIG. 35B).

In one embodiment, functional RNA, peptide or protein, such as antibodies expressed by the adenovirus of the present disclosure enter the blood stream and/or lymphatic system.

In one embodiment the adenovirus of the present disclosure is an oncolytic virus which has an enhanced therapeutic index for cancer cells.

In one embodiment the coding sequence encodes functional RNA, for example therapeutic RNA.

Functional RNA as employed herein refers to RNA which has a function other than to encode a protein or peptide and includes for examples include RNA constructs suitable for inhibiting or reducing gene activity, including RNAi, such as shRNA and miRNA. shRNA as employed herein refers to short hairpin RNA which is a sequence of RNA that makes a tight hairpin turn that can be used to silence target gene expression via RNA interference (RNAi). miRNA (microRNA) as employed herein refers to a small non-coding RNA molecule (containing about 22 nucleotides) which functions, via base-pairing with complementary sequences within mRNA molecules, to regulate gene expression at the transcriptional or post-transcriptional level. mRNA strands bound by miRNA are silenced because they can no longer be translated into proteins by ribosomes, and such complexes are often actively disassembled by the cell.

In one embodiment the transgene encodes a protein. Protein as employed herein includes a protein ligand, a protein receptor, or an antibody molecule.

Protein ligand as employed herein refers to cell surface membrane or secreted proteins binding fragments thereof, that bind to or otherwise engage with the cellular receptors to influence the function of the cell, for example by stimulating intracellular signalling and modulating gene transcription within the cell. In one embodiment the protein expressed is engineered to be expressed on the surface of the cell and/or secreted from the cell.

In one embodiment the protein encoded is an enzyme, for example an enzyme that assists in degrading the extracellular matrix of the tumour, for example a DNAse, a collagenase, a matrix metalloproteinase (such as MMP2 or 14) or similar.

Suitable antibodies and antibody fragments may be agonistic or antagonistic and include those with anticancer activity and those which modify host cell responses to the cancer, for example: an agonist or antagonistic antibody or antibody fragment may decrease vascularization or normalise vascularization of the tumour. In one embodiment agonistic antibodies or other encoded proteins may render the host cell more visible to the host's innate and adaptive immune responses, for example by expressing antigens, danger signals, cytokines or chemokines to attract and activate the same, or by binding to co-stimulatory or checkpoint pathway molecules to enhance adaptive immune responses.

Therapeutic antibody or antibody-binding fragment as employed herein refers to antibody or antibody-binding fragment which, when inserted in to the oncolytic virus, has a beneficial impact on a pathology in the patient, for example on the cancer being treated.

Beneficial impact as employed herein refers to a desirable and/or advantageous effect of the antibody being expressed in vivo.

Classes of therapeutic antibodies and antibody-binding fragments include: anti-EGF antibodies, anti-VEGF antibodies, anti-PDGF antibodies, anti-CTLA antibodies, anti-PD1 antibodies, anti-PDL1 antibodies and anti-FGF antibodies.

Registered therapeutic antibodies suitable for incorporation into viruses of the present disclosure include: abciximab, adalimumab, alemtzumab, basiliximab, beliximab, bevacizumab, brentuximab vedotin, canakinumab, cetuximab, certolzumab, daclizumab, denosumab, eculzumab, efalixumab, gemtuzumab, golimumab, ibritumomab tiuxetan, infliximab, ipilimumab, muromonab-CD3, ofatumumab, palivizumab, panitumumab, ranibizumab, rituximab, tocilizumab, tositumomab and trastuzumab.

In one embodiment the antibody variable region sequences of an antibody or antibody fragment employed are between 95 and 100% similar or identical to the variable regions of bevacizumab (also known as Avastin®), such as 96, 97, 98 or 99% similar or identical.

Also suitable for incorporation into viruses of the present disclosure are the coding sequences for those antibodies and binding fragments thereof which are approved for a cancer indications, for example trastuzumab, tositumomab, rituximab, panitumumab, ofatumumab, ipilimumab, ibritumomab tiuxetan, gemtuzumab, denosumab, cetuximab, brentuximab vedotin, avastin and adalimumab.

In one embodiment the antibody variable region sequences of an antibody or antibody fragment employed are between 95 and 100% similar or identical to the variable regions of a known antibody or an antibody disclosed herein.

As used herein "antibody molecule" includes antibodies and binding fragments thereof.

Antibody as employed herein generally refers to a full length antibody and bispecific or multi-specific formats comprising the same.

Antibody-binding fragments includes an antibody fragment able to target the antigen with the same, similar or better specificity to the original "antibody" from which it was derived. Antibody fragments include: Fab, modified Fab, Fab', modified Fab', F(ab')$_2$, Fv, single domain antibodies (e.g. VH or VL or VHH), scFv, bi, tri or tetra-valent antibodies, Bis-scFv, diabodies, triabodies, tetrabodies and epitope-binding fragments of any of the above (see for example Holliger and Hudson, 2005, Nature Biotech. 23(9): 1126-1136; Adair and Lawson, 2005, Drug Design Reviews—Online 2(3), 209-217). The methods for creating and manufacturing these antibody fragments are well known in the art (see for example Verma et al., 1998, Journal of Immunological Methods, 216, 165-181). Other antibody fragments for use in the present invention include the Fab and Fab' fragments described in international patent applications WO2005/003169, WO2005/003170 and WO2005/003171. Multi-valent antibodies may comprise multiple specificities e.g. bispecific or may be monospecific (see for example WO 92/22853, WO05/113605, WO2009/040562 and WO2010/035012).

Specific as employed herein is intended to refer to an antibody or fragment that only recognises the antigen to which it is specific or to an antibody or fragment that has significantly higher binding affinity to the antigen to which is specific in comparison to its binding affinity to antigens to which it is not specific, for example 5, 6, 7, 8, 9, 10 times higher binding affinity.

Known antibodies or antibody-binding fragments can be employed to generate alternative antibody formats with the same CDRs or the same variable regions, for example, a full-length antibody can readily be converted into a Fab, Fab' or scFv fragment.

A wide range of different forms of antibody may be employed in constructs of the present disclosure including antibody molecules from non-human animals, human antibody molecules, humanised antibody molecules and chimeric antibody molecules.

In one embodiment the antibody or binding fragment is monoclonal. Monoclonal antibodies may be prepared by any method known in the art such as the hybridoma technique (Kohler & Milstein, 1975, Nature, 256:495-497), the trioma technique, the human B-cell hybridoma technique (Kozbor et al., 1983, Immunology Today, 4:72) and the EBV-hybridoma technique (Cole et al., Monoclonal Antibodies and Cancer Therapy, pp 77-96, Alan R Liss, Inc., 1985).

In one embodiment the antibody or binding fragment is non-human, i.e. completely from non-human origin. This is possible because the antibodies and fragments can be delivered inside the cancer cell by the virus.

In one embodiment the antibody is chimeric, for example has human constant region(s) and non-human variable regions.

In one embodiment the antibody or binding fragment is human, i.e. from completely human origin.

In one embodiment the antibody or binding fragment is humanised. Humanised antibodies (which include CDR-grafted antibodies) are antibody molecules having one or more complementarity determining regions (CDRs) from a non-human species and a framework region from a human immunoglobulin molecule (see, for example U.S. Pat. No. 5,585,089; WO91/09967). It will be appreciated that it may only be necessary to transfer the specificity determining residues of the CDRs rather than the entire CDR (see for example, Kashmiri et al., 2005, Methods, 36, 25-34). Humanised antibodies may optionally further comprise one or more framework residues derived from the non-human species, for example from which the CDRs were derived.

In one embodiment the coding sequence encodes an antibody heavy chain an antibody light chain or an antibody fragment. Heavy chain (HC) as employed herein refers to the large polypeptide subunit of an antibody. Light chain (LC) as employed herein refers to the small polypeptide subunit of an antibody. In one embodiment the antibody light chain comprises a CL domain, either kappa or lambda.

Antibodies for use in the present disclosure may be obtained using any suitable a method known in the art. The antigen polypeptide/protein including fusion proteins, including cells (recombinantly or naturally) expressing the polypeptide (such as activated T cells) can be used to produce antibodies which specifically recognise the antigen. The polypeptide may be the 'mature' polypeptide or a biologically active fragment or derivative thereof.

Polypeptides, for use to immunise a host animal, may be prepared by processes well known in the art from genetically engineered host cells comprising expression systems or they may be recovered from natural biological sources. In the present application, the term "polypeptides" includes peptides, polypeptides and proteins. These are used interchangeably unless otherwise specified. The antigen polypeptide may in some instances be part of a larger protein such as a fusion protein for example fused to an affinity tag.

Antibodies generated against the antigen polypeptide may be obtained, where immunisation of an animal is necessary, by administering the polypeptides to an animal, preferably a non-human animal, using well-known and routine protocols, see for example Handbook of Experimental Immunology, D. M. Weir (ed.), Vol 4, Blackwell Scientific Publishers, Oxford, England, 1986). Many warm-blooded animals, such as rabbits, mice, rats, sheep, cows, camels or pigs may be immunised. However, mice, rabbits, pigs and rats are generally most suitable.

Antibodies for use in the invention may also be generated using single lymphocyte antibody methods by cloning and expressing immunoglobulin variable region cDNAs generated from single lymphocytes selected for the production of specific antibodies by, for example, the methods described by Babcook, J. et al., 1996, Proc. Natl. Acad. Sci. USA 93(15):7843-78481; WO92/02551; WO2004/051268 and International Patent Application number WO2004/106377.

Screening for antibodies can be performed using assays to measure binding to antigen and/or assays to measure the ability to antagonise the receptor. An example of a binding assay is an ELISA, in particular, using a fusion protein (optionally comprising a reporter), which is immobilized on plates, and employing a conjugated secondary antibody to detect anti-antigen antibody bound to the fusion protein.

The constant region domains of the antibody molecule of the present invention, if present, may be selected having regard to the proposed function of the antibody molecule, and in particular the effector functions which may be required. For example, the constant region domains may be human IgA, IgD, IgE, IgG or IgM domains. In particular, human IgG constant region domains may be used, especially of the IgG1 and IgG3 isotypes when the antibody molecule is intended for therapeutic uses and antibody effector functions are required. Alternatively, IgG2 and IgG4 isotypes may be used when the antibody molecule is intended for therapeutic purposes and antibody effector functions are not required, e.g. for simply agonising activity or for target neutralization. It will be appreciated that sequence variants of these constant region domains may also be used. For example IgG4 molecules in which the serine at position 241 has been changed to proline as described in Angal et al., Molecular Immunology, 1993, 30 (1), 105-108 may be used.

For certain antibody functions, for example for delivering activation signals to cells bearing the antibody's target molecule, such as cells of the immune system, it may be advantageous to use membrane-anchored versions of the antibody such that the antibody will be expressed on the surface of the expressing cell. Such cell surface expressed binding molecules enable efficient multimeric interactions between the target signalling molecule on the surface of another cell which enhances delivery of activation signals from the target molecule into the recipient cell.

Advantageously, the adenoviruses of the present disclosure can express full length and scFv forms of antibodies.

In one embodiment the sequence encoding the antibody or antibody fragment comprise or further comprises an internal ribosome entry sequence. Internal ribosome entry sequence (IRES) as employed herein means a nucleotide sequence that allows for translation initiation in the middle of a messenger RNA (mRNA) sequence.

In one embodiment the encoded therapeutic proteins or peptides are target specific proteins, polypeptides or peptides.

Target specific proteins or peptides as employed herein refers to either the target proteins themselves, or different proteins or peptides that directly bind (for example are specific to the target) to or otherwise modify the levels of the target proteins or peptides. An example of the former would be a cytokine, whilst an example of the latter would be an antibody against that cytokine.

Targets of interest generally relate to particular cells, cellular products, antigens or signalling pathways associated with disease, particularly cancer. Target, depending on the context, also relates to mRNA or similar transcribed from the gene encoding the protein or polypeptide, which for example can be inhibited by RNAi type technology. Thus in the context of RNA, such as RNAi technology the target is the mRNA which is encoded by the gene of the target.

Examples of targets of interest include, but are not limited to, stimulatory T-cell co-receptors and ligands thereto, checkpoint inhibitory T-cell co-receptor molecules and ligands thereto, receptors and ligands thereto expressed by regulatory T-cells, myeloid derived suppressor cells and immunosuppressive immune cells, dendritic cell and antigen-presenting cell receptors and ligands thereto, antigen processing and presentation mediators, cytokines and cytokine receptors, chemokines and chemokine receptors, transcription factors and regulators of transcription, intracellular trafficking molecules and regulators of cell function, tumour cell and tumour microenvironmental receptors and products, intracellular tumour cell enzymes such as IDO, antigens for recognition by immune cells.

Thus in one embodiment target as employed herein refers to a protein or polypeptide which can, for example be inhibited, neutralised or activated by, for example an antibody or binding fragment there, as appropriate. Target in the context of cytokines refers to a cytokine per se or an antibody or binding fragment thereof specific to the cytokine. Thus, the virus may encode and express the cytokine itself as release of thereof may stimulate "host" immune responses. In the context of ligands, mutated forms of the ligand can be encoded by the virus which compete with the natural ligand to bind the receptor. The mutated ligand may have increased binding affinity for the receptor, for example such that it has a slow off-rate thereby occupying the receptor and increasing or decreasing signalling therefrom. Alternatively, the activity of the mutated ligand may be reduced in comparison to the wild-type ligand, thereby reducing the binding and overall activity through the receptor from the natural ligand.

In one embodiment the virus or construct according to the present disclosure encodes a pro-drug, an immunomodulator and/or an enzyme.

Pro-drug as employed herein means a molecule that is administered as an inactive (or less than fully active) derivative that is subsequently converted to an active pharmacological agent in the body, often through normal metabolic processes. A pro-drug serves as a type of precursor to the intended drug. A pro-drug converting enzyme serves as the enzyme that converts a pro-drug to its pharmacologically active form.

Immunomodulator as employed herein means a modulator of immune response. Immunomodulators function in adjustment of the immune response to a desired level, as in immunopotentiation, immunosuppression, or induction of immunologic tolerance.

Enzyme as employed herein means a substance that acts as a catalyst in living organisms, regulating the rate at which chemical reactions proceed without itself being altered in the process.

The following is a non-exhaustive discussion of exemplary target peptides/polypeptides and proteins.

In one embodiment the target is one or more independently selected from the group comprising: CTLA-4, PD-1, PD-L1, PD-L2, VISTA, B7-H3, B7-H4, HVEM, ILT-2, ILT-3, ILT-4, TIM-3, LAG-3, BTLA, LIGHT or CD160, for example CTLA-4, PD-1, PD-L1 and PD-L2. In one embodiment there is provided an antibody or binding fragment thereof which is specific to one of the same. Thus in one embodiment a transgene or transgene cassette encodes an antibody or antibody fragment specific to CTLA-4, PD-1, PD-L1 or PD-L2. In one embodiment the adenovirus expresses an antibody or antibody fragment specific to CTLA-4, PD-1, PD-L1 or PD-L2.

In one embodiment the antibody is a checkpoint inhibitor antibody, for example anti-PD-L1. In one embodiment the adenovirus expresses full length anti-human PD-L1 antibody. In one embodiment the expression of full length anti-human PD-L1 antibody is under the control of an endogenous promoter, such as the major late promoter (MLP), in particular in position $B_y$. In one embodiment the adenovirus expresses the scFv form of anti-human PD-L1 antibody. In one embodiment the expression of a scFv form of anti-human PD-L1 antibody is under the control of an endogenous promoter, such as the Major late promoter, in particular in position $B_y$.

In one embodiment the amino acid sequence of the anti-PD-L1 antibody VH chain encoded by a virus or construction of the present disclosure is SEQ ID NO: 30. In one embodiment the amino acid sequence of the anti-PD-L1 antibody constant heavy chain is SEQ ID NO: 33 or 34. In one embodiment the amino acid sequence of the anti-PD-L1 antibody VL chain is SEQ ID NO: 32. In one embodiment the amino acid sequence of the anti-PD-L1 antibody constant light chain is SEQ ID NO: 35. In one embodiment amino acid sequence of the anti-PD-L1 scFv antibody fragment is SEQ ID NO: 37.

In one embodiment there is provided a virus or construct according to the present disclosure encoding an antibody or binding fragment thereof, for a full-length antibody or scFv specific to CTLA-4, for example as exemplified herein.

In one embodiment the target, is one or more independently selected from the group comprising CD16, CD25, CD33, CD332, CD127, CD31, CD43, CD44, CD162, CD301a, CD301b and Galectin-3. In one embodiment there is provided an antibody or binding fragment thereof specific thereto, for example a full-length antibody or a scFv.

In one embodiment the target, for example which may be targeted by an antibody or binding fragment, is one or more independently selected from the group comprising: FLT-3, FLT-3 ligand, TLRs, TLR ligands, CCR7, CD1a, CD1c, CD11b, CD11c, CD80, CD83, CD86, CD123, CD172a, CD205, CD207, CD209, CD273, CD281, CD283, CD286, CD289, CD287, CXCR4, GITR Ligand, IFN-α2, IL-12, IL-23, ILT1, ILT2, ILT3, ILT4, ILTS, ILT7, TSLP Receptor, CD141, CD303, CADM1, CLEC9a, XCR1 and CD304.

Certain TLR ligands have the ability to stimulate immune responses and, for example are employed as adjuvants. In one embodiment the virus encodes and secretes a TRL ligand.

In one embodiment the target is selected from an antigen processor and antigen presentation mediator, for example CTIIA or GILT.

In one embodiment the target, for example which may be targeted by an antibody or binding fragment, is a cancer target.

In one embodiment the target is one or more independently selected from the group comprising: OX40, OX40 ligand, CD27, CD28, CD30, CD40, CD40 ligand, CD70, CD137, GITR, 4-1BB, ICOS or ICOS ligand, for example CD40 and CD40 ligand.

In one embodiment the transgene cassette encodes a ligand comprising CD40 or CD40 ligand, or an antibody, antibody fragment or shRNA targeted to CD40 or CD40 ligand. In one embodiment the adenovirus expresses a ligand comprising CD40 or CD40 ligand, or an antibody, antibody fragment or shRNA targeted to (specific to) CD40 or CD40 ligand.

In one embodiment the target is one or more independently selected from the group comprising: IL-1α, IL-1β, IL-6, IL-9, IL-12, IL-13, IL-17, IL-18, IL-22, IL-23, IL-24, IL-25, IL-26, IL-27, IL-33, IL-35. Interleukin-2 (IL-2), IL-4, IL-5, IL-7, IL-10, IL-15, IL-21, IL-25, IL-1RA, IFNα, IFNβ, IFNγ, TNFα, TGFβ, lymphotoxin α (LTA) and GM-CSF.

In one embodiment the transgene cassette encodes an antibody or antibody fragment specific to IL-12, IL-18, IL-22, IL-7, IL-15, IL-21, IFNα, IFNγ, TNFα, TGFβ or lymphotoxin α (LTA). In one embodiment the adenovirus expresses IL-12, IL-18, IL-22, IL-7, IL-15, IL-21, IFNα, IFNγ, TNFα,TGFβ or lymphotoxin α (LTA).

In one embodiment the amino acid sequence of IFNγ is SEQ ID NO: 41. In one embodiment the amino acid sequence of IFNα is SEQ ID NO: 42. In one embodiment the amino acid sequence of TNFα is SEQ ID NO: 40.

In one embodiment the target is a chemokine, for example one or more independently selected from the group comprising: IL-8, CCL5, CCL17, CCL20, CCL22, CXCL9, CXCL10, CXCL11, CXCL13, CXCL12, CCL2, CCL19, CCL21, CXCR2, CCR2, CCR4, CCR5, CCR6, CCR7, CCR8, CXCR3, CXCR4, CXCR5 and CRTH2.

In one embodiment the transgene cassette encodes an antibody or antibody fragment specific to CCL5, CXCL9, CXCL12, CCL2, CCL19, CCL21, CXCR2, CCR2, CCR4 or CXCR4. In the context of the chemokines target includes where the viruses encodes and expresses the chemokine, for example to induce or augment host immune responses to the cancer.

In one embodiment the adenovirus expresses an antibody or antibody fragment specific to CCL5, CXCL9, CXCL12, CCL2, CCL19, CCL21, CXCR2, CCR2, CCR4 or CXCR4.

In one embodiment the target is one or more independently selected from the group comprising: STAT3, STAT1, STAT4, STATE, CTIIA, MyD88 and NFκB family members, for example the protein is targeted with an inhibitor, for example an antibody or bind fragment thereof, or mRNA transcribed from the relevant gene is inhibited by a mechanism, such as RNAi.

In one embodiment the target is HSp70 or a regulator of cell survival and death such as survivin, for example the protein is targeted with an inhibitor, for example an antibody or bind fragment thereof, or mRNA transcribed from the relevant gene is inhibited by a mechanism, such as RNAi.

In one embodiment the target is one or more independently selected from the group comprising: amphiregulin, BTC, NRG1a, NRG1b, NRG3, TGFα, LRIG1, LRIG3, EGF, EGF-L6, Epigen, HB-EGF, EGFR, Her2, Her3 and Her4, for example the protein is targeted with an inhibitor, for example an antibody or bind fragment thereof, or mRNA transcribed from the relevant gene is inhibited by a mechanism, such as RNAi.

In one embodiment the target is a ligand or receptor for one or more independently selected from the group comprising: hedgehog, FGF, IGF, Wnt, VEGF, TNF, TGFβ, PDGF and Notch.

In one embodiment the adenovirus expresses an antibody or antibody fragment specific to VEGF. In one embodiment the antibody is an anti-VEGF antibody. For example, such as an antibody having the amino acid sequence of the antibody Bevacizumab or equivalent thereto. In one embodiment the adenovirus expresses full length anti-human VEGF antibody. In one embodiment the expression of full length anti-human VEGF antibody is under the control of an endogenous promoter, such as the Major late promoter (MLP), in particular in position $B_Y$. In one embodiment the adenovirus expresses the scFv form of anti-human VEGF antibody. In one embodiment the expression of the scFv form of anti-human VEGF antibody is under the control of an endogenous promoter, such as the Major late promoter, in particular in position $B_Y$. In one embodiment the amino acid sequence of the anti-VEGF antibody VH chain is SEQ ID NO: 29. In one embodiment the amino acid sequence of the anti-VEGF antibody constant heavy chain is SEQ ID NO: 33 or 34. In one embodiment the amino acid sequence of the anti-VEGF antibody VL chain is SEQ ID NO: 31. In one embodiment the amino acid sequence of the anti-VEGF antibody constant light chain is SEQ ID NO: 35. In one embodiment amino acid sequence of the anti-VEGF scFv antibody fragment is SEQ ID NO: 36.

In one embodiment the target is IDO.

In one embodiment the target is an antigen for recognition by immune cells for one or more proteins or peptides independently selected from the group comprising: immunogenic proteins from infectious organisms, such as cytomegalovirus antigens, influenza antigens, hepatitis B surface and core antigens, diphtheria toxoid, Crm197, tetanus toxoid; peptides derived from such antigens which are known T-cell or antibody epitopes, or genetically engineered composites or multimers of such antigens; tumour-derived proteins as antigens; peptides derived from such antigens which are known T-cell or antibody epitopes; and genetically engineered composites or multimers of such antigens for example WT1, MUC1, LMP2, idiotype, HPV E6&E7, EGFRvIII, HER-2/neu, MAGE A3, p53 nonmutant, p53 mutant, NY-ESO-1, GD2, PSMA, PCSA, PSA, gp100, CEA, MelanA/MART1, Ras mutant, proteinase3 (PR1), bcr-abl, tyrosinase, survivin, PSA, hTERT, particularly WT1, MUC1, HER-2/neu, NY-ESO-1, survivin or hTERT.

The skilled person will appreciate that many possibilities exist for nucleic acid sequences that encode a given amino acid sequence due to codon redundancy, that silent nucleic acid base pair mutations are tolerated and all nucleic acid sequences that encode a given amino acid sequence as defined in any of the SEQ ID NO's are envisioned by the present disclosure.

In one embodiment the peptide, polypeptide or protein encoded by a transgene is a mimotope. As employed herein a mimotope is a molecule, often a peptide, which mimics the structure of an epitope. The latter property causes an antibody response similar to the one elicited by the epitope. An antibody for a given epitope antigen will recognize a mimotope which mimics that epitope. Mimotopes are commonly obtained from phage display libraries through biopanning. Vaccines utilizing mimotopes are being developed. Thus antibodies of known specificity may be used to screen libraries (e.g. peptide libraries in phage display—for example Ab sequence libraries or non-antibody peptide libraries, particularly those optimized for producing peptides with more stable 3D conformations)—Generation of mimotopes is well described in the art (see Tribbick G, Rodda S. Combinatorial methods for discovery of peptide ligands which bind to antibody-like molecules. J Mol Recognit. 2002 15(5):306-10; Masuko T, Ohno Y, Masuko K, Yagi H, Uejima S, Takechi M, Hashimoto Y. Towards therapeutic antibodies to membrane oncoproteins by a robust strategy using rats immunized with transfectants expressing target molecules fused to green fluorescent protein. Cancer Sci. 2011 102(1):25-35).

In one embodiment a mimotope or other designed vaccine antigens are encoded by a transgene and expressed in order to induce an antibody response in the recipient patient, wherein the antibodies induced have the desired therapeutic effect. In one embodiment GFP-peptide fusion proteins, with peptide sequences from desired human ligand, are used to induce anti-self target antibody responses, for example a peptide region of PD-L1 that is known to be important for binding to target molecule PD-1 may be genetically linked with GFP or other highly immunogenic foreign carrier proteins such that an immune antibody response to the peptide includes antibodies that cross-react with the native PDL1 molecule and thus serve to block PD-L1:PD-1 interactions in the same way as directly encoding an anti-PDL1 antibody would. Concepts for vaccines inducing ant-self therapeutic antibody responses are well described in the art (see Spohn G, Bachmann M F. Therapeutic vaccination to block receptor-ligand interactions. Expert Opin Biol Ther. 2003 3(3):469-76; Link A, Bachmann M F. Immunodrugs: breaking B– but not T-cell tolerance with therapeutic anti-cytokine vaccines. Immunotherapy 2010 2(4):561-74; Delavallee L, Assier E, Semerano L, Bessis N, Boissier M C. Emerging applications of anticytokine vaccines. Expert Rev Vaccines. 2008 7(10):1507-17).

In one or more embodiments the transgene employed encodes a sequence shown in any one of SEQ ID NO: 29 to 44, 67 & 70-71.

Advantageously adenoviruses of the present disclosure express and release antibody forms and other proteins such as cytokines encoded by a transgene therein into the culture supernatant in vitro or into tumour tissue stroma in vivo (see FIGS. 4-8, 11-12, 16-19, 28-29, 33, 35, 38-40, 42-43,47, 49, 51,).

Leader sequences may assist the encoded proteins/polypeptide or peptide exiting the cancer cell. Therefore, in one embodiment the encoded "protein" comprises a leader sequence. Leader sequence as employed herein refers to a polynucleotide sequence located between the promoter sequence and the coding region which can regulate gene expression at the level of transcription or translation.

In one embodiment the coding sequence encodes a peptide. Peptide as employed herein refers to an amino acid chain which is not a complete functional protein. Typically a fragment which retains some or all of the function of the protein that it is a fragment of, or can be recognized by the immune system, for example peptides of 8 or more amino acids that can be recognized by T-cells.

In one embodiment the transgene is a reporter gene encoding, for example an imaging agent including bioluminescent, fluorescent imaging agents (including activatable fluorescent imaging agents), such as luciferase, GFP or eGFP or red fluorescent protein.

Reporter gene or reporter sequence as employed herein means a gene or DNA sequence that produces a product easily detected in eukaryotic cells and may be used as a marker to determine the activity of another gene with which its DNA has been closely linked or combined. Reporter genes confer characteristics on cells or organisms expressing them that are easily identified and measured, or are selectable markers. Reporter genes are often used as an indication of whether a certain gene has been taken up by or expressed in the cell or organism population. Examples of common reporter genes include, but are not limited to, LacZ, luciferase, GFP, eGFP, neomycin phosphotransferase, chloramphenicol acetyltransferase, sodium iodide symporter (NIS), nitroreductase (e.g. NfsA, NfsB) intracellular metalloproteins, HSV1-tk or oestrogen receptor.

In one embodiment the genetic material (in particular the transgene) does not encode or express a reporter gene such as an imaging agent, luciferase, GFP or eGFP.

In one embodiment the amino acid sequence of NIS is SEQ ID NO: 67

Viruses according to the present disclosure can be investigated for their preference for a specific tumour type by examination of its lytic potential in a panel of tumor cells, for example colon tumor cell lines include HT-29, DLD-1, LS174T, LS1034, SW403, HCT116, SW48, and Colo320DM. Any available colon tumour cell lines would be equally useful for such an evaluation.

Prostate cell lines include DU145 and PC-3 cells. Pancreatic cell lines include Panc-1 cells. Breast tumour cell lines include MDA231 cell line and ovarian cell lines include the OVCAR-3 cell line. Hemopoietic cell lines include, but are not limited to, the Raji and Daudi B-lymphoid cells, K562 erythroblastoid cells, U937 myeloid cells, and HSB2 T-lymphoid cells. Other available tumour cell lines are equally useful.

The present disclosure also extends to novel sequences disclosed herein. In one embodiment the virus is shown in any one of sequences discloses herein, for example SEQ ID NOs: 1 to 9, SEQ ID NOs: 48-53 SEQ ID NO: 56-63, SEQ ID NO: 66, SEQ ID NO: 68-69 and SEQ ID NO: 72-73.

Formulations

The present disclosure relates also extends to a pharmaceutical formulation of a virus as described herein.

In one embodiment there is provided a liquid parenteral formulation, for example for infusion or injection, of a replication capable oncolytic according to the present disclosure wherein the formulation provides a dose in the range of $1\times10^{10}$ to $1\times10^{14}$ viral particles per volume of dose.

Parenteral formulation means a formulation designed not to be delivered through the GI tract. Typical parenteral delivery routes include injection, implantation or infusion. In one embodiment the formulation is provided in a form for bolus delivery.

In one embodiment the parenteral formulation is in the form of an injection. Injection includes intravenous, subcutaneous, intra-tumoral or intramuscular injection. Injection as employed herein means the insertion of liquid into the body via a syringe. In one embodiment the method of the present disclosure does not involve intra-tumoral injection.

In one embodiment the parenteral formulation is in the form of an infusion.

Infusion as employed herein means the administration of fluids at a slower rate by drip, infusion pump, syringe driver or equivalent device. In one embodiment the infusion is administered over a period in the range of 1.5 minutes to 120 minutes, such as about 3, 4, 5, 6, 7, 8, 9, 10, 11, 12, 13, 14 15, 16, 17, 18, 19 20, 25, 30, 35, 40, 45, 50, 55, 60, 65, 70, 65, 80, 85, 90, 95, 100, 105, 110 or 115 minutes.

In one embodiment one dose of the formulation less than 100 mls, for example 30 mls, such as administered by a syringe driver.

In one embodiment the injection is administered as a slow injection, for example over a period of 1.5 to 30 minutes.

In one embodiment the formulation is for intravenous (i.v.) administration. This route is particularly effective for delivery of oncolytic virus because it allows rapid access to the majority of the organs and tissue and is particular useful for the treatment of metastases, for example established metastases especially those located in highly vascularised regions such as the liver and lungs.

Therapeutic formulations typically will be sterile and stable under the conditions of manufacture and storage. The composition can be formulated as a solution, microemulsion, liposome, or other parenteral formulation suitable for administration to a human and may be formulated as a pre-filled device such as a syringe or vial, particular as a single dose.

The formulation will generally comprise a pharmaceutically acceptable diluent or carrier, for example a non-toxic, isotonic carrier that is compatible with the virus, and in which the virus is stable for the requisite period of time.

The carrier can be a solvent or dispersion medium containing, for example, water, ethanol, polyol (for example, glycerol, propylene glycol, and liquid polyethylene glycol, and the like), and suitable mixtures thereof. The proper fluidity can be maintained, for example, by the use of a dispersant or surfactant such as lecithin or a non-ionic surfactant such as polysorbate 80 or 40. In dispersions the maintenance of the required particle size may be assisted by the presence of a surfactant. Examples of isotonic agents include sugars, polyalcohols such as mannitol, sorbitol, or sodium chloride in the composition.

In one embodiment parenteral formulations employed may comprise one or more of the following a buffer, for example 4-(2-hydroxyethyl)-1-piperazineethanesulfonic acid, a phosphate buffer and/or a Tris buffer, a sugar for example dextrose, mannose, sucrose or similar, a salt such as sodium chloride, magnesium chloride or potassium chloride, a detergent such as a non-ionic surfactant such as briji, PS-80, PS-40 or similar. The formulation may also comprise a preservative such as EDTA or ethanol or a combination of EDTA and ethanol, which are thought to prevent one or more pathways of possible degradation.

In one embodiment the formulation will comprise purified oncolytic virus according to the present disclosure, for example $1\times10^{10}$ to $1\times10^{14}$ viral particles per dose, such as $1\times10^{10}$ to $1\times10^{12}$ viral particles per dose. In one embodiment the concentration of virus in the formulation is in the range $2\times10^{8}$ to $2\times10^{14}$ vp/mL, such as $2\times10^{12}$ vp/ml.

In one embodiment the parenteral formulation comprises glycerol.

In one embodiment the formulation comprises oncolytic adenovirus as described herein, HEPES (N-2-hydroxyethylpiperazine-N'-2-ethanesulfonic acid), glycerol and buffer.

In one embodiment the parenteral formulation consists of virus of the disclosure, HEPES for example 5 mM, glycerol for example 5-20% (v/v), hydrochloric acid, for example to adjust the pH into the range 7-8 and water for injection.

In one embodiment 0.7 mL of virus of the disclosure at a concentration of $2\times10^{12}$ vp/mL is formulated in 5 mM HEPES, 20% glycerol with a final pH of 7.8.

A thorough discussion of pharmaceutically acceptable carriers is available in Remington's Pharmaceutical Sciences (Mack Publishing Company, N.J. 1991).

In one embodiment the formulation is provided as a formulation for topical administrations including inhalation.

Suitable inhalable preparations include inhalable powders, metering aerosols containing propellant gases or inhalable solutions free from propellant gases. Inhalable powders according to the disclosure will generally contain a virus as described herein with a physiologically acceptable excipient.

These inhalable powders may include monosaccharides (e.g. glucose or arabinose), disaccharides (e.g. lactose, saccharose, maltose), oligo- and polysaccharides (e.g. dextranes), polyalcohols (e.g. sorbitol, mannitol, xylitol), salts (e.g. sodium chloride, calcium carbonate) or mixtures of these with one another. Mono- or disaccharides are suitably used, the use of lactose or glucose, particularly but not exclusively in the form of their hydrates.

Particles for deposition in the lung require a particle size less than 10 microns, such as 1-9 microns for example from 0.1 to 5 μm, in particular from 1 to 5 μm. The particle size of the carrying the virus is of primary importance and thus in one embodiment the virus according to the present disclosure may be adsorbed or absorbed onto a particle, such as a lactose particle of the given size.

The propellant gases which can be used to prepare the inhalable aerosols are known in the art. Suitable propellant gases are selected from among hydrocarbons such as n-propane, n-butane or isobutane and halohydrocarbons such as chlorinated and/or fluorinated derivatives of methane, ethane, propane, butane, cyclopropane or cyclobutane. The above-mentioned propellant gases may be used on their own or in mixtures thereof.

Particularly suitable propellant gases are halogenated alkane derivatives selected from among TG 11, TG 12, TG 134a and TG227. Of the abovementioned halogenated hydrocarbons, TG134a (1,1,1,2-tetrafluoroethane) and TG227 (1,1,1,2,3,3,3-heptafluoropropane) and mixtures thereof are particularly suitable.

The propellant gas-containing inhalable aerosols may also contain other ingredients, such as cosolvents, stabilisers, surface-active agents (surfactants), antioxidants, lubricants and means for adjusting the pH. All these ingredients are known in the art.

The propellant gas-containing inhalable aerosols according to the invention may contain up to 5% by weight of active substance. Aerosols according to the invention contain, for example, 0.002 to 5% by weight, 0.01 to 3% by weight, 0.015 to 2% by weight, 0.1 to 2% by weight, 0.5 to 2% by weight or 0.5 to 1% by weight of active ingredient.

Alternatively topical administrations to the lung may also be by administration of a liquid solution or suspension formulation, for example employing a device such as a nebulizer, for example, a nebulizer connected to a compressor (e.g., the Pari LC-Jet Plus(R) nebulizer connected to a Pari Master(R) compressor manufactured by Pari Respiratory Equipment, Inc., Richmond, Va.).

The virus of the invention can be delivered dispersed in a solvent, e.g. in the form of a solution or a suspension, for example as already described above for parenteral formulations. It can be suspended in an appropriate physiological solution, e.g., saline or other pharmacologically acceptable solvent or a buffered solution. Buffered solutions known in the art may contain 0.05 mg to 0.15 mg disodium edetate, 8.0 mg to 9.0 mg NaCl, 0.15 mg to 0.25 mg polysorbate, 0.25 mg to 0.30 mg anhydrous citric acid, and 0.45 mg to 0.55 mg sodium citrate per 1 ml of water so as to achieve a pH of about 4.0 to 5.0.

The therapeutic suspensions or solution formulations can also contain one or more excipients. Excipients are well known in the art and include buffers (e.g., citrate buffer, phosphate buffer, acetate buffer and bicarbonate buffer), amino acids, urea, alcohols, ascorbic acid, phospholipids, proteins (e.g., serum albumin), EDTA, sodium chloride, liposomes, mannitol, sorbitol, and glycerol. Solutions or suspensions can be encapsulated in liposomes or biodegradable microspheres. The formulation will generally be provided in a substantially sterile form employing sterile manufacture processes.

This may include production and sterilization by filtration of the buffered solvent/solution used for the formulation, aseptic suspension of the antibody in the sterile buffered solvent solution and dispensing of the formulation into sterile receptacles by methods familiar to those of ordinary skill in the art.

Nebulisable formulation according to the present disclosure may be provided, for example, as single dose units (e.g., sealed plastic containers or vials) packed in foil envelopes. Each vial contains a unit dose in a volume, e.g., 2 mL, of solvent/solution buffer.

Treatment

In a further aspect the present disclosure extends to a virus or a formulation thereof as described herein for use in treatment, in particular for the treatment of cancer.

In one embodiment the method of treatment is for use in the treatment of a tumour.

Tumour as employed herein is intended to refer to an abnormal mass of tissue that results from excessive cell division that is uncontrolled and progressive, also called a neoplasm. Tumours may be either benign (not cancerous) or malignant. Tumour encompasses all forms of cancer and metastases.

In one embodiment the tumour is a solid tumour. The solid tumour may be localised or metastasised.

In one embodiment the tumour is of epithelial origin.

In one embodiment the tumour is a malignancy, such as colorectal cancer, hepatoma, prostate cancer, pancreatic cancer, breast cancer, ovarian cancer, thyroid cancer, renal cancer, bladder cancer, head and neck cancer or lung cancer.

In one embodiment the tumour is a colorectal malignancy.

Malignancy as employed herein means cancerous cells.

In one embodiment the oncolytic adenovirus is employed in the treatment or prevention of metastasis.

In one embodiment the method or formulation herein is employed in the treatment of drug resistant cancers.

In one embodiment the virus is administered in combination with the administration of a further cancer treatment or therapy.

In one embodiment there is provided a virus or formulation according to the present disclosure for use in the manufacture of a medicament for the treatment of cancer, for example a cancer described above.

In a further aspect there is provide a method of treating cancer comprising administering a therapeutically effective amount of a virus or formulation according to the present disclosure to a patient in need thereof, for example a human patient.

In one embodiment the oncolytic virus or formulation herein is administered in combination with another therapy.

"In combination" as employed herein is intended to encompass where the oncolytic virus is administered before, concurrently and/or post cancer treatment or therapy.

Cancer therapy includes surgery, radiation therapy, targeted therapy and/or chemotherapy. Cancer treatment as employed herein refers to treatment with a therapeutic compound or biological agent, for example an antibody intended to treat the cancer and/or maintenance therapy thereof.

In one embodiment the cancer treatment is selected from any other anti-cancer therapy including a chemotherapeutic agent, a targeted anticancer agent, radiotherapy, radio-isotope therapy or any combination thereof.

In one embodiment the virus of the present disclosure such as an oncolytic adenovirus may be used as a pre-treatment to the therapy, such as a surgery (neoadjuvant therapy), to shrink the tumour, to treat metastasis and/or prevent metastasis or further metastasis. The oncolytic adenovirus may be used after the therapy, such as a surgery (adjuvant therapy), to treat metastasis and/or prevent metastasis or further metastasis.

Concurrently as employed herein is the administration of the additional cancer treatment at the same time or approximately the same time as the oncolytic adenovirus formulation. The treatment may be contained within the same formulation or administered as a separate formulation.

In one embodiment the virus is administered in combination with the administration of a chemotherapeutic agent.

Chemotherapeutic agent as employed herein is intended to refer to specific antineoplastic chemical agents or drugs that are selectively destructive to malignant cells and tissues. For example, alkylating agents, antimetabolites, anthracyclines, plant alkaloids, topoisomerase inhibitors, and other antitumour agents. Other examples of chemotherapy include doxorubicin, 5-fluorouracil (5-FU), paclitaxel, capecitabine, irinotecan, and platins such as cisplatin and oxaliplatin. The preferred dose may be chosen by the practitioner based on the nature of the cancer being treated.

In one embodiment the therapeutic agent is ganciclovir, which may assist in controlling immune responses and/or tumour vascularisation.

In one embodiment one or more therapies employed in the method herein are metronomic, that is a continuous or frequent treatment with low doses of anticancer drugs, often given concomitant with other methods of therapy.

Subgroup B oncolytic adenoviruses, in particular Ad11 and those derived therefrom such as EnAd may be particularly synergistic with chemotherapeutics because they seem to have a mechanism of action that is largely independent of apoptosis, killing cancer cells by a predominantly necrolytic mechanism. Moreover, the immunosuppression that occurs during chemotherapy may allow the oncolytic virus to function with greater efficiency.

Therapeutic dose as employed herein refers to the amount of virus, such as oncolytic adenovirus that is suitable for achieving the intended therapeutic effect when employed in a suitable treatment regimen, for example ameliorates symptoms or conditions of a disease. A dose may be considered a therapeutic dose in the treatment of cancer or metastases when the number of viral particles may be sufficient to result in the following: tumour or metastatic growth is slowed or stopped, or the tumour or metastasis is found to shrink in size, and/or the life span of the patient is extended. Suitable therapeutic doses are generally a balance between therapeutic effect and tolerable toxicity, for example where the side-effect and toxicity are tolerable given the benefit achieved by the therapy.

In one embodiment a virus or therapeutic construct according to the present disclosure (including a formulation comprising same) is administered weekly, for example one week 1 the dose is administered on day 1, 3, 5, followed by one dose each subsequent week.

In one embodiment a virus or therapeutic construct according to the present disclosure (including a formulation comprising same) is administered bi-weekly or tri-weekly, for example is administered in week 1 one on days 1, 3 and 5, and on week 2 or 3 is also administered on days 1, 3 and 5 thereof. This dosing regimen may be repeated as many times as appropriate.

In one embodiment a virus or therapeutic construct according to the present disclosure (including a formulation comprising same) is administered monthly.

In one embodiment the viruses and constructs of the present disclosure are prepared by recombinant techniques. The skilled person will appreciate that the armed adenovirus genome can be manufactured by other technical means, including entirely synthesising the genome or a plasmid comprising part of all of the genome. The skilled person will appreciate that in the event of synthesising the genome the region of insertion may not comprise the restriction site nucleotides as the latter are artefacts following insertion of genes using cloning methods.

In one embodiment the armed adenovirus genome is entirely synthetically manufactured, for example as per SEQ ID NO: 63.

The disclosure herein further extends to an adenovirus of formula (I) or a subformula thereof, obtained or obtainable from inserting a transgene or transgene cassette.

"Is" as employed herein means comprising.

In the context of this specification "comprising" is to be interpreted as "including".

Embodiments of the invention comprising certain features/elements are also intended to extend to alternative embodiments "consisting" or "consisting essentially" of the relevant elements/features.

Where technically appropriate, embodiments of the invention may be combined.

Technical references such as patents and applications are incorporated herein by reference. Any embodiments specifically and explicitly recited herein may form the basis of a disclaimer either alone or in combination with one or more further embodiments.

The present invention is further described by way of illustration only in the following examples, which refer to the accompanying Figures, in which:

HEK293 cells were transfected with purified NG-135 genomic DNA and monitored for virus production by observation of cytopathic effect (CPE). Microscopy images (A-E) show CPE, characterised by plaque formation in the cell monolayer, could be observed from 144 hrs post-transfection, virus was harvested 216 hrs post infection (E). Harvested virus was amplified in HEK293 cells, harvesting when CPE was observed after 72 hrs (F-G) and then amplified a second time, harvesting when CPE was observed after 48 hrs (H-I).

Figure 1:
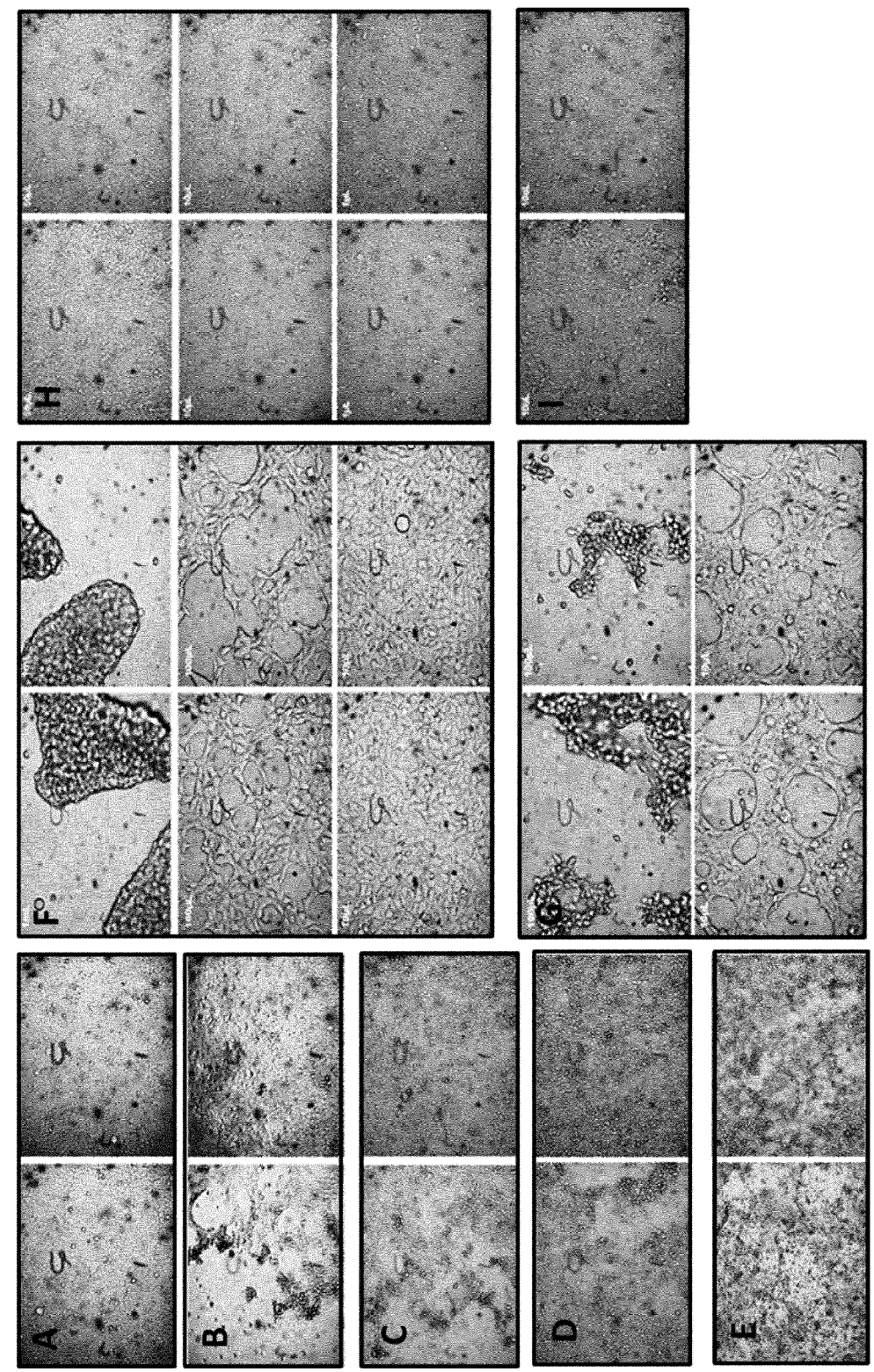
FIG. 1 shows the transfection and amplification of NG-135 virus particles in HEK293 cells post-transfection with the NG-135 virus genome.
Figure 2:
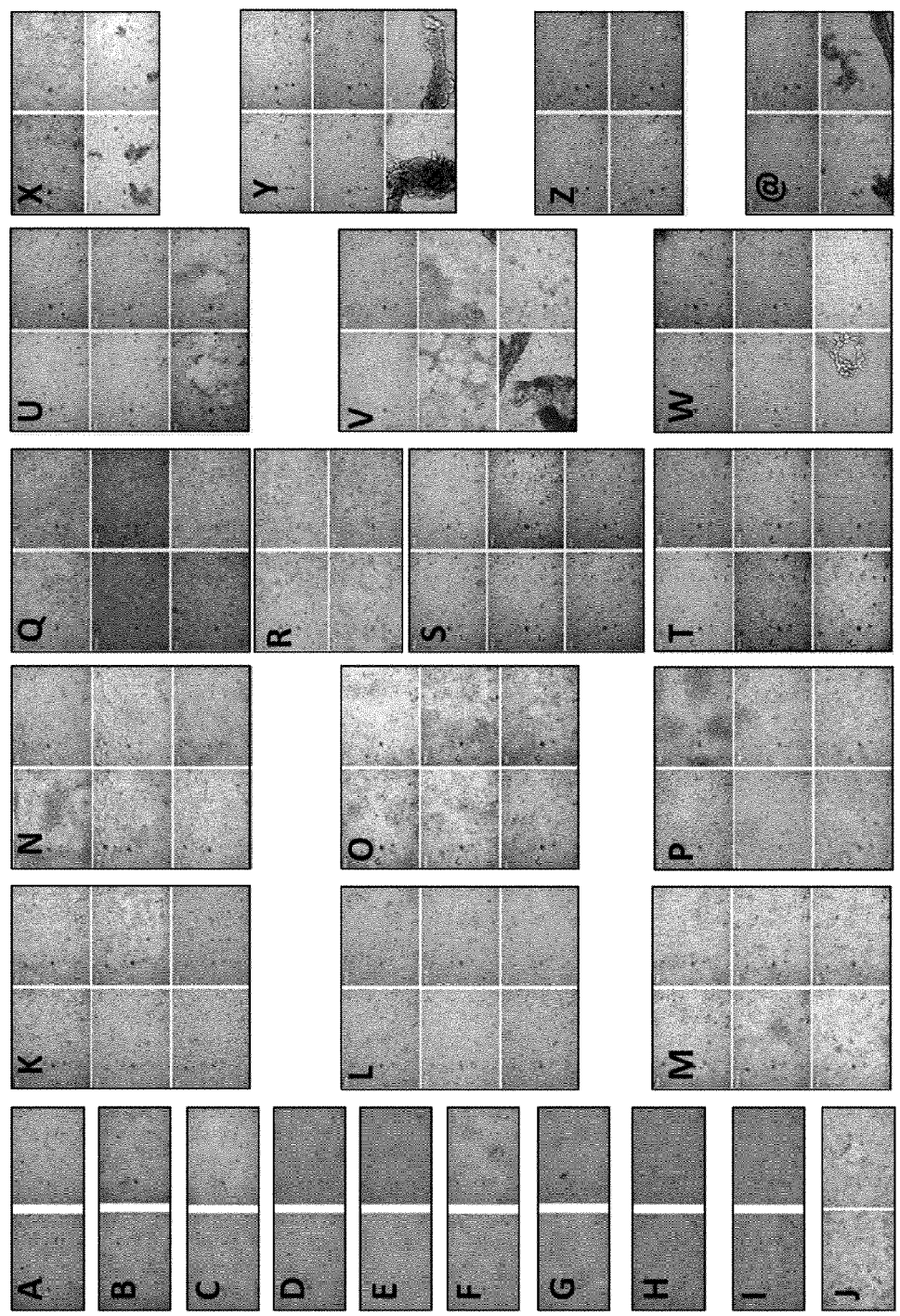

FIG. 2 shows the transfection and amplification of NG-74 virus particles in HEK293 cells post-transfection with the NG-74 virus genome.

HEK293 cells were transfected with purified NG-74 genomic DNA and monitored for virus production by observation of cytopathic effect (CPE). Microscopy images (A-J) show CPE, characterised by plaque formation in the cell monolayer, could be observed from 336 hrs post-transfection, virus was harvested 384 hrs post infection (J). Harvested virus was amplified in HEK293 cells (K-R), harvesting when CPE was observed after 240 hrs (R) and then amplified second (S-V), third (W-X), fourth (Y-Z) and fifth (@) time harvesting when significant CPE was observed.

Figure 3:
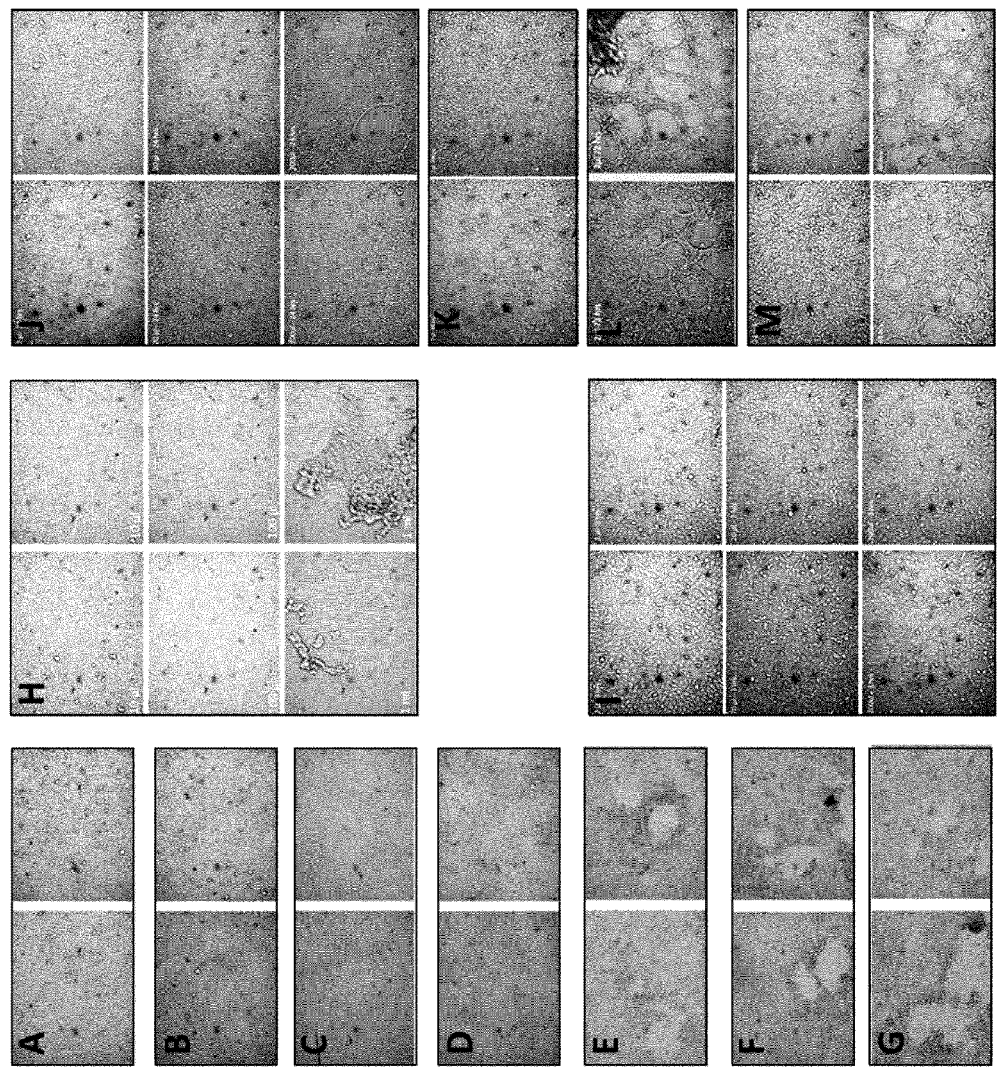

FIG. 3 shows the transfection and amplification of NG-73 virus particles in HEK293 cells post-transfection with the NG-73 virus genome.

HEK293 cells were transfected with purified NG-73 genomic DNA and monitored for virus production by observation of cytopathic effect (CPE). Microscopy images (A-G) show CPE, characterised by plaque formation in the cell monolayer, could be observed from 144 hrs post-transfection, virus was harvested 192 hrs post infection. Harvested virus was amplified in HEK293 cells (H) and then amplified a second (I-L) and third time (M), harvesting when significant CPE was observed.

Figure 4A:
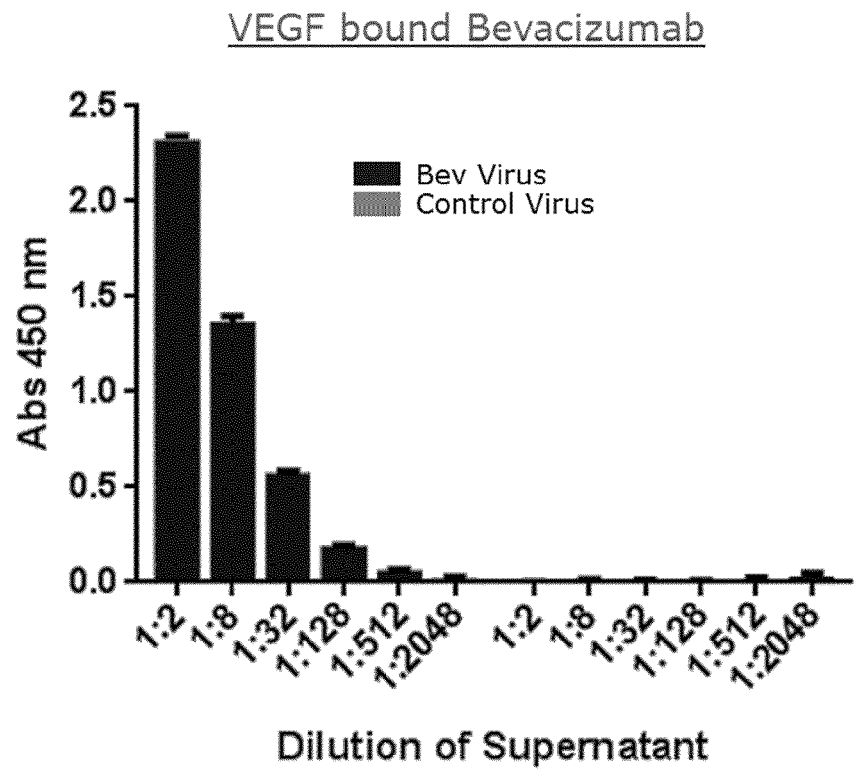

FIG. 4 shows ELISA detection of Anti-VEGF antibody secreted from NG-135 infected HEK293 cells.

HEK293 cells were infected in vitro for 72 hrs with either a control virus, NG-47, or anti-VEGF antibody expressing virus, NG-135. Human IgG1 anti-VEGF antibody levels in culture supernatants were measured by ELISA using human VEGF coated plates and an anti-human IgG-Fc detection antibody (A). Antibody levels were quantified using a standard curve of the purified human anti-VEGF antibody, bevacizumab (B).

Figure 5:
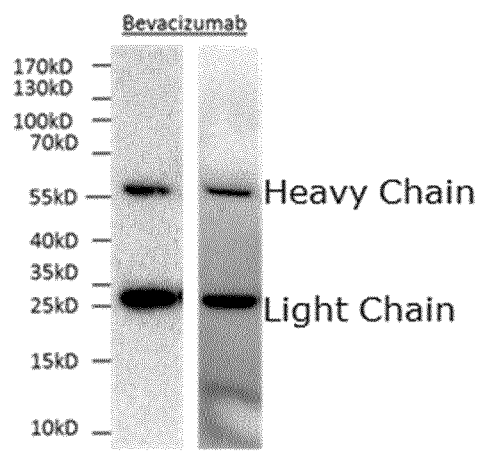

FIG. 5 shows western blot detection of anti-VEGF antibody secreted from NG-135 infected HEK293 cells.

HEK293 cells were infected in vitro for 24 hrs with the anti-VEGF antibody expressing virus, NG-135. Human IgG1 anti-VEGF antibody in culture supernatants was assessed by western blotting with an anti-human IgG-detection antibody.

Figure 6:
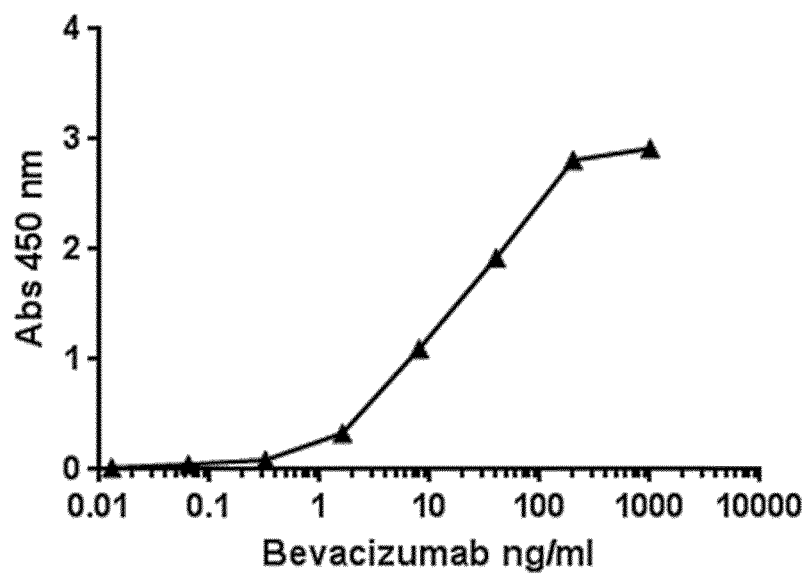

FIG. 6 shows purified human anti-VEGF antibody, bevacizumab, standard curve.

Purified human anti-VEGF antibody, bevacizumab, was serially diluted and quantified by ELISA using human VEGF coated plates. This determined the concentrations required for production of a bevacizumab standard curve for use in ELISA.

Figure 7:
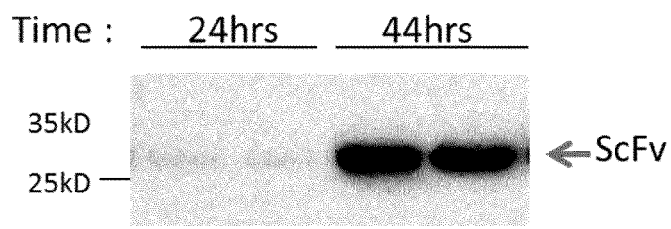

FIG. 7 shows western blot detection of anti-VEGF ScFv secreted from NG-76 infected HEK293 cells.

HEK293 cells were infected with NG-76 virus, cultured for 24 or 44 hrs and then assessed for the expression of anti-VEGF ScFv by Western blotting using an anti-His tag antibody to detect the encoded ScFv product.

Figure 8:
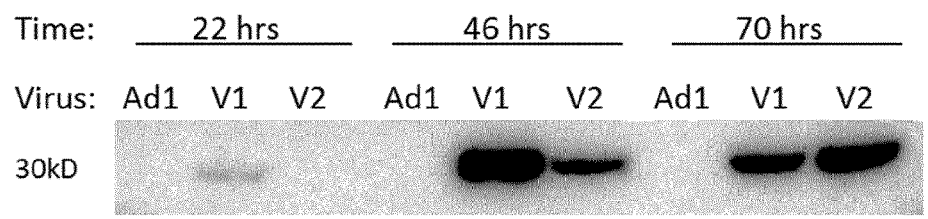

FIG. 8 shows western blot detection of anti-VEGF ScFv secreted from NG-76 or NG-78 infected colon carcinoma cells.

HT-29 colon carcinoma cells were infected with EnAd, NG-76 or NG-78 viruses, cultured for 22, 46 or 70 hrs and then assessed for expression of anti-VEGF ScFv by Western blotting using an anti-His tag antibody to detect the encoded ScFv product (A).

Figure 9:
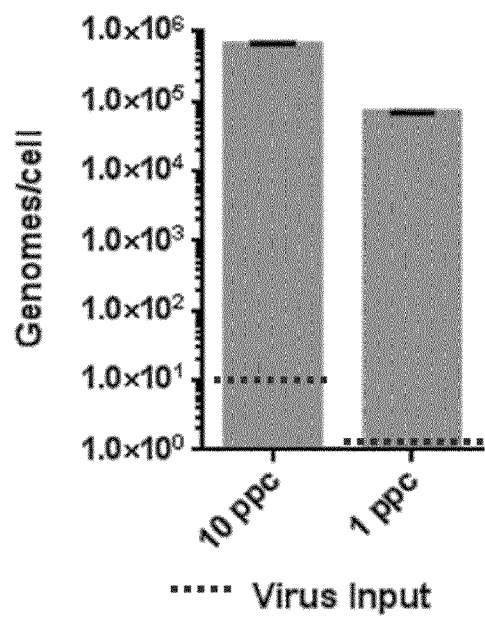

FIG. 9 shows NG-76 virus replication 48 hrs post-infection in HT-29 cells.

HT-29 colon carcinoma cells were infected with 10 or 1 NG-76 virus particles per cell (ppc), cultured for 48 hrs and then assessed for virus genome expression by qPCR.

FIG. 10 shows schematics outlining the construction of anti-VEGF antibody transgene cassettes.

Sequences for full (heavy and light chains) or ScFv versions of anti-VEGF antibodies were inserted into the EnAd2.4 genome between the Sbf and Sgf restriction sites located downstream of the virus L5 (Fibre) gene.

Figure 11:
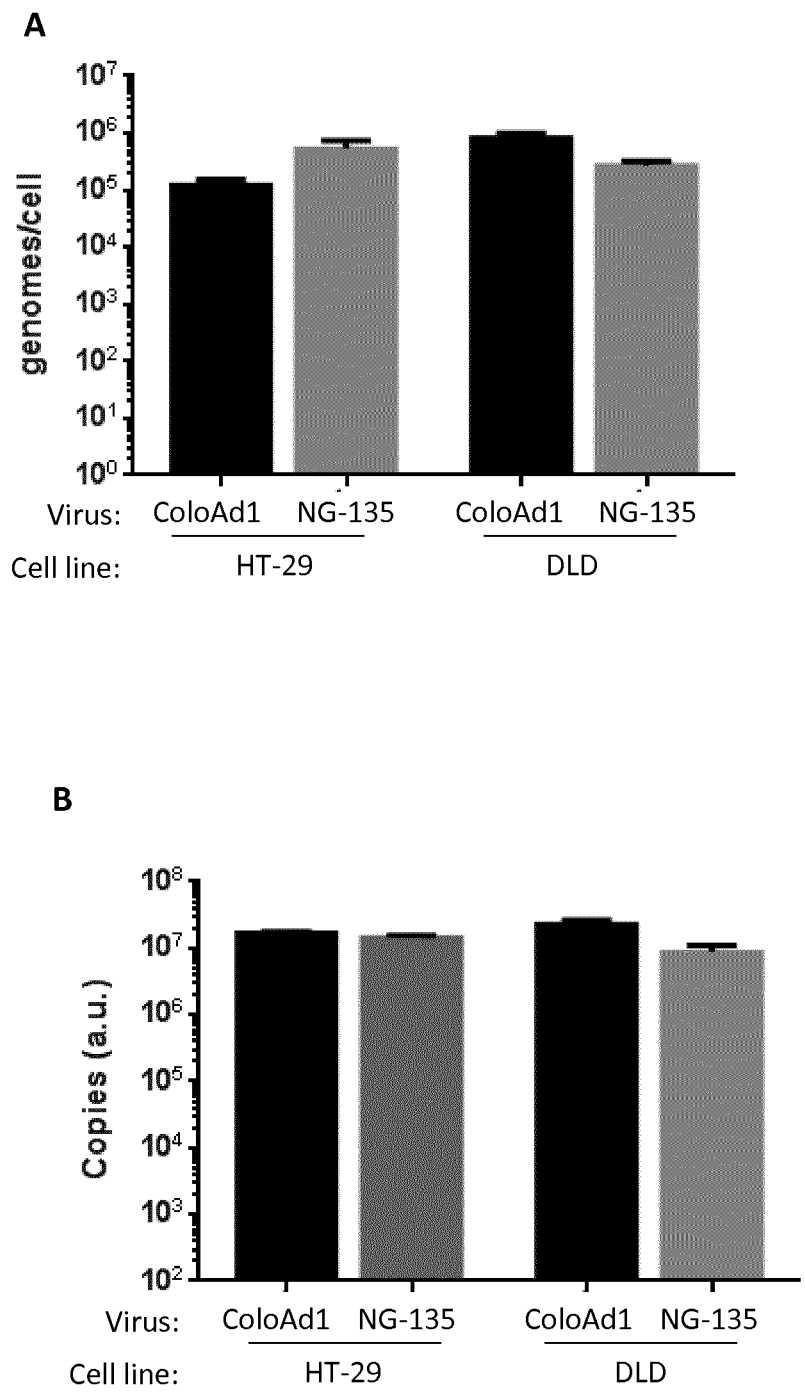

FIG. 11 shows NG-135 virus replication and gene expression is comparable to EnAd in colon carcinoma cell lines. HT-29 and DLD human colorectal carcinoma cell lines were infected in vitro with either EnAd or NG-135 and cultured for 3 days. Virus replication (measured by viral DNA quantification using qPCR) and virus gene (hexon) expression (measured by viral RNA quantification using RTqPCR) were assessed. Comparable data were obtained with both viruses (A & B).

FIG. 12 shows detectable anti-VEGF antibody gene expression in NG-135 infected colon carcinoma cell lines. HT-29 and DLD human colorectal carcinoma cell lines were infected in vitro with either EnAd or NG-135, cultured for 3 days and then evaluated for expression of anti-VEGF antibody by RTqPCR of RNA from cells.

FIG. 13 shows anti-VEGF antibody is present in the supernatants of NG-135 infected colon carcinoma cell lines and can bind hVEGF-165. HT-29, DLD and HCT-116 human colorectal carcinoma cell lines were infected in vitro with either EnAd or NG-135, cultured for 3 days. Human IgG1 anti-VEGF antibody levels in culture supernatants were measured by ELISA using human VEGF coated plates and an anti-human IgG-Fc detection antibody. Antibody levels were quantified using a standard curve of the purified human anti-VEGF antibody, bevacizumab.

FIG. 14 shows anti-VEGF ScFv is present in the supernatants of NG-76 infected colon carcinoma cell lines and can bind hVEGF-165. HT-29 colon carcinoma cells were infected with EnAd, NG-76 or NG-78 viruses, cultured for 22, 46 or 70 hrs and then assessed for expression of anti-VEGF ScFv by Western blotting using an anti-His tag to detect the encoded ScFv product (A).

ScFv expression in Human embryonic kidney cells was assessed by VEGF binding ELISA. Specificity of the expressed ScFv for VEGF was confirmed by the inhibition of VEGF binding by including a low concentration of the purified human anti-VEGF antibody, bevacizumab, in the ELISA (B).

FIG. 15 NG-135 virus replication is comparable to EnAd in a subcutaneous xenograft model implanted with DLD cells. DLD human colon carcinoma cells were implanted as a subcutaneous xenograft in CD1 nu/nu mice and the established tumours were injected with $5 \times 10^9$ EnAd or NG-135 virus particles. Virus replication in the tumours was assessed on days 3, 7 (A, n=4 per time point) or day 28 post infection (B, n=10) by qPCR.

FIG. 16 shows anti-VEGF antibody gene expression is detected in a NG-135 treated subcutaneous DLD tumour model. DLD human colon carcinoma cells were implanted as a subcutaneous xenograft in CD1 nu/nu mice and the established tumours were injected with $5 \times 10^9$ EnAd or NG-135 virus particles. Virus hexon gene (A) and encoded anti-VEGF antibody heavy chain gene expression (B) (mRNA) was assessed by RTqPCR of tumour tissue RNA on days 3 and 7 post-treatment.

FIG. 17 shows anti-VEGF antibody is expressed in NG-135 treated subcutaneous DLD tumour model. DLD human colon carcinoma cells were implanted as a subcutaneous xenograft in CD1 nu/nu mice and the established tumours were injected with $5 \times 10^9$ EnAd (n=4) or NG-135 (n=8) virus particles. Tumours were excised on day 28 post infection, homogenized and soluble extracts assessed for total human IgG1 content (A) and anti-VEGF antibody (B) by ELISA. Extracts from one of the EnAd tumours were spiked with 8 ng/ml of human anti-VEGF antibody (bevacizumab) as a positive control in each ELISA.

FIG. 18 NG-135 infection of a subcutaneous xenograft model shows anti-VEGF antibody expression and virus replication in HCT-116 tumours.

HCT-116 human colon carcinoma cells were implanted as a subcutaneous xenograft in CD1 nu/nu mice and the established tumours were injected with $5 \times 10^9$ EnAd or NG-135 virus particles. Tumours were excised on days 3, 7 and 14 (n=5 per time point). Virus replication was assessed by qPCR (A) and tissue expression of anti-VEGF antibody (human IgG1) was determined by human IgG ELISA (B).

FIG. 19 anti-VEGF antibody can be detected in the peripheral circulation 28 days after NG-135 treatment in a xenograft tumour model. DLD human colon carcinoma cells were implanted as a subcutaneous xenograft in CD1 nu/nu mice and the established tumour injected with $5 \times 10^9$ EnAd or NG-135 virus particles. Levels of anti-VEGF antibody in the peripheral circulation of the tumour-bearing mice was assessed by human IgG1 ELISA assays. Background subtracted absorbance at 450 nm is shown in (A) and the concentration of anti-VEGF antibody was quantified using a standard curve of the purified human anti-VEGF antibody, bevacizumab (B).

FIG. 20 shows schematic of example elements that may be present in transgene cassette.

FIG. 21 shows schematic of example elements encoded in transgene cassettes.

FIG. 22 shows schematics of transgene cassettes encoding reporter genes.

FIG. 23 shows schematics of transgene cassettes encoding cytokines.

FIG. 24 shows schematics of transgene cassettes encoding antibodies or antibody domains.

FIG. 25 shows virus replication and functional reporter protein expression in colon carcinoma cell lines infected with NG-47 and NG-61 viruses. HT-29 human colorectal carcinoma cell lines were infected for 24, 48, 72 or 96 hrs with EnAd or viruses NG-47 or NG-61, which express the reporter proteins GFP or luciferase, respectively. Virus replication was assessed by qPCR at each time point and was comparable to EnAd (A-B). GFP expression was assessed by level of detectable fluorescence in cell lysates (C).

FIG. 26 shows NG-47 and NG-61 virus oncolytic potency is comparable to EnAd. HT-29 human colorectal carcinoma cell lines were infected with EnAd, NG-47 or NG-61 virus particles. 72 hrs post infection cell viability was quantified and plotted at % cell survival (A-B). Both NG-47 and NG-61 virus potency was equivalent to EnAd in HT29 cell lines (A-B) and in HT29, W138 and MRC5 cell lines (C).

Figure 27:
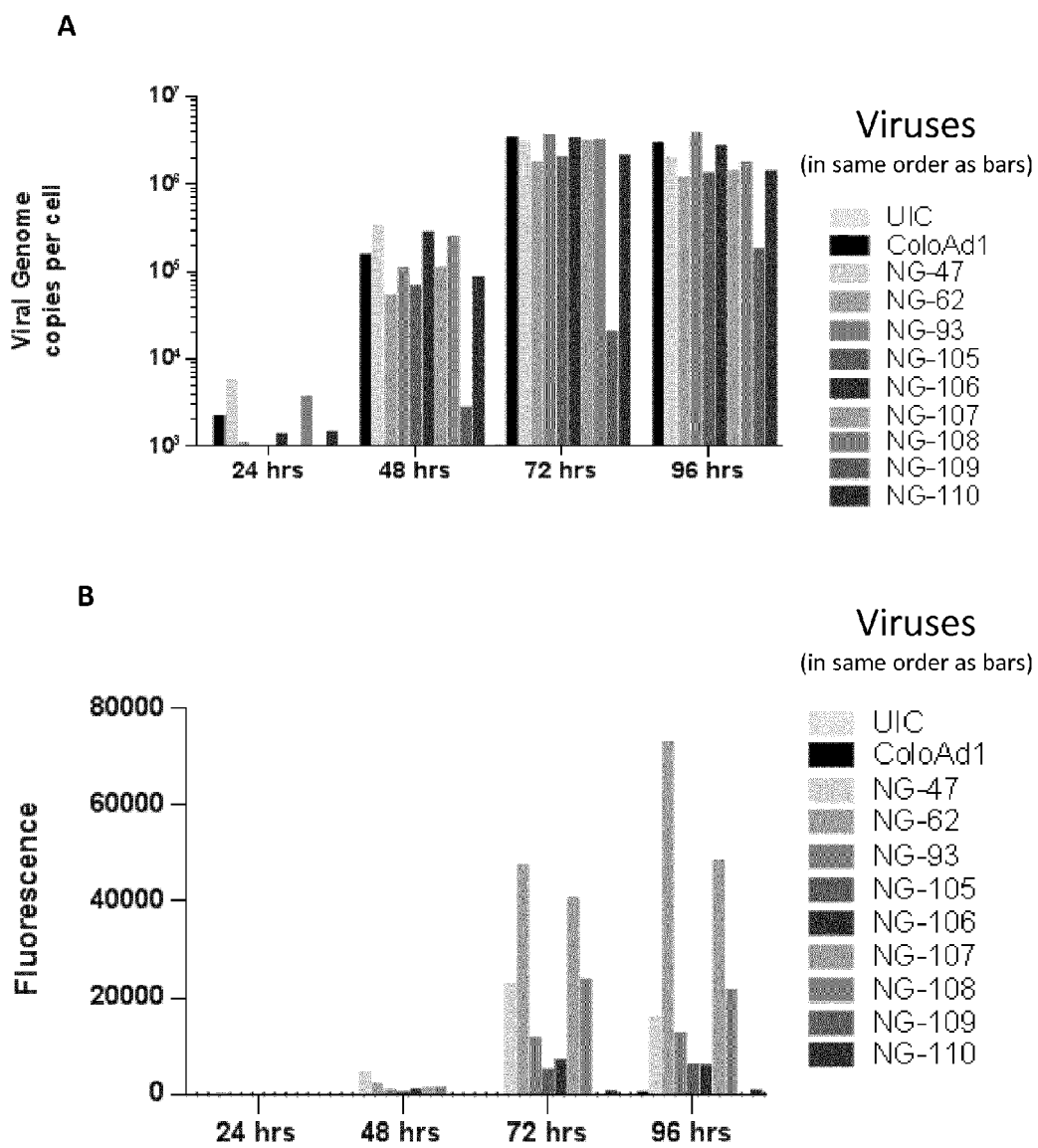

FIG. 27 shows virus replication and transgene expression in a panel of EnAd viruses expressing reporter genes. HT-29 human colorectal carcinoma cell lines were infected with EnAd or a panel of viruses which express GFP under an exogenous promoter, CMV, the endogenous major late promoter (MLP) or endogenous E4 promoter. After 24, 48, 72 or 96 hrs virus replication was assessed by qPCR (A) and GPF expression was quantified by fluorescence detection on a plate reader (B).

Figure 28:
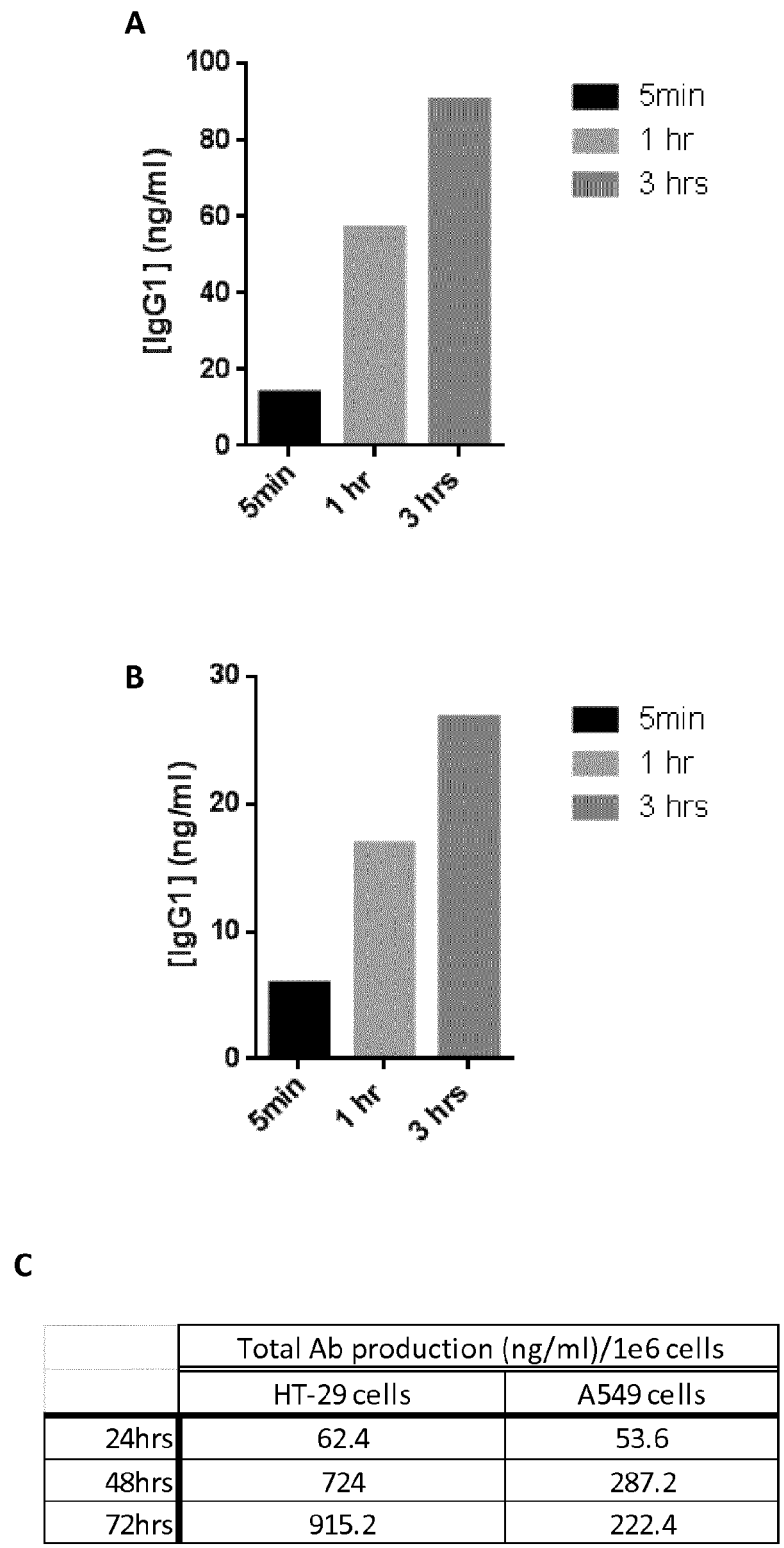

FIG. 28 shows anti-VEGF antibody production in NG-135 infected colon and lung carcinoma cell lines. HT-29 human colorectal carcinoma or A549 lung carcinoma cell lines were infected for 24, 48 or 72 hrs with NG-135 virus particles. At each timepoint antibody production in the cellular supernatant was assessed over 5 mins, 1 hr or 3 hrs by IgG1 ELISA (HT-29 data are shown in A, A549 data are shown in B). Calculation of the amount of IgG1 produced per 1e6 cells in 24, 48 or 72 hrs is shown in the table (C).

FIG. 29 shows NG-139 virus production and TNFα expression in colon carcinoma cell lines infected with virus NG-139. HT-29 cells were infected with NG-139 virus for 36 hrs before virus production was assessed by visualisation of CPE and staining for production of the virus capsid protein Hexon by immunohistochemistry (IHC) (A and B). TNFα production in NG-139 infected cell supernatant was assessed by ELISA and is quantified in the table shown in (C). DLD human colon carcinoma cells were implanted as a subcutaneous xenograft in CD1 nu/nu mice and the established tumour treated on 3 occasions with $5 \times 10^9$ EnAd or NG-135 virus particles. Levels of TNF in the tumours 15 days post treatment was assessed by ELISA (D).

Figure 30:
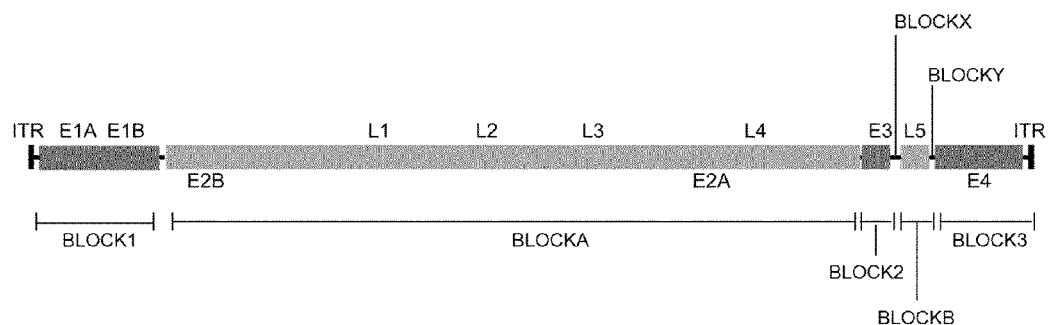

FIG. 30 shows a map of the genome architecture of adenoviruses.

Figure 31:
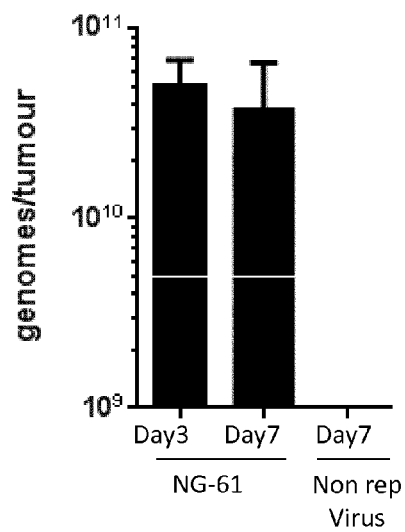

FIG. 31 shows NG-61 virus replication Day 3 and Day 7 post-treatment in a subcutaneous xenograft model implanted with DLD cells.

Figure 32:
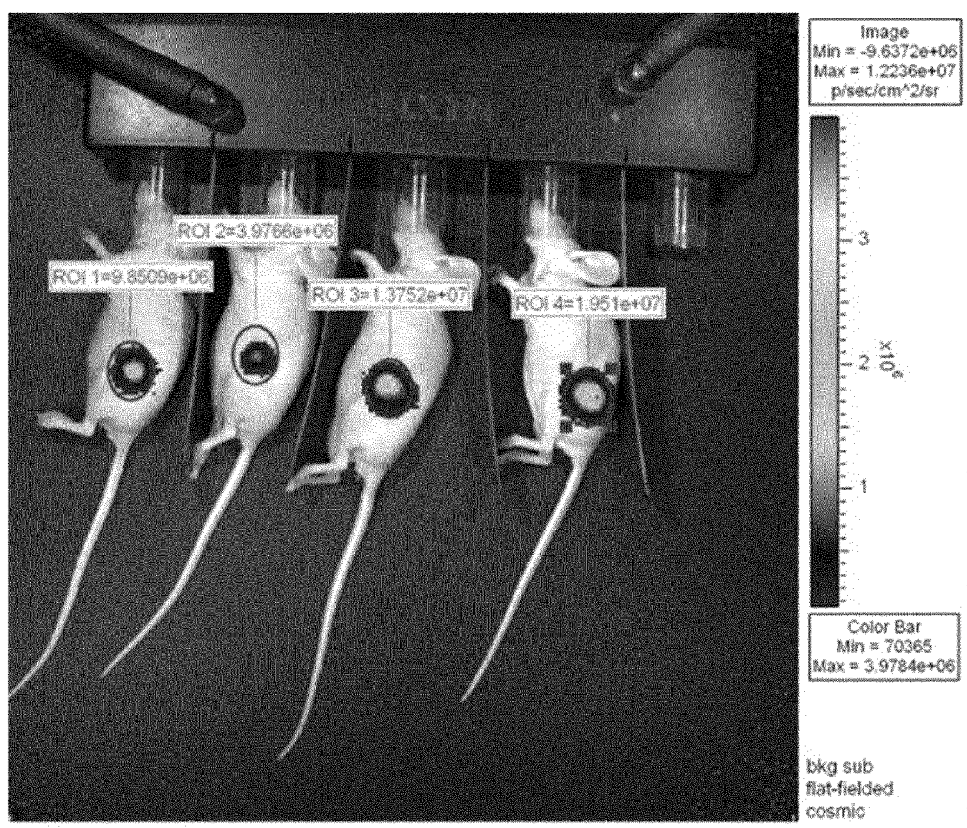

FIG. 32 shows luciferase transgene expression in tumours Day 7 post-treatment in a subcutaneous xenograft model implanted with DLD cells.

FIG. 33 shows NG-135 virus replication and anti-VEGF antibody expression in colon, lung and ovarian carcinoma cell lines. HT-29, HCT-116, DLD (colon), SKOV (ovarian) or A549 (lung) carcinoma cell lines were infected with NG-135 or EnAd virus particles for 24-120 hrs. Virus replication was assessed every 24 hrs by qPCR and the maximum replication across the time course plotted in (A). Anti-VEGF antibody production was also measured every 24 hrs by IgG1 ELISA and the total antibody secreted into the cell supernatant at each time point is shown in (B).

FIG. 34 shows schematics of transgene cassettes encoding a tumour associated antigen, antibodies or antibody domains.

Figure 35:
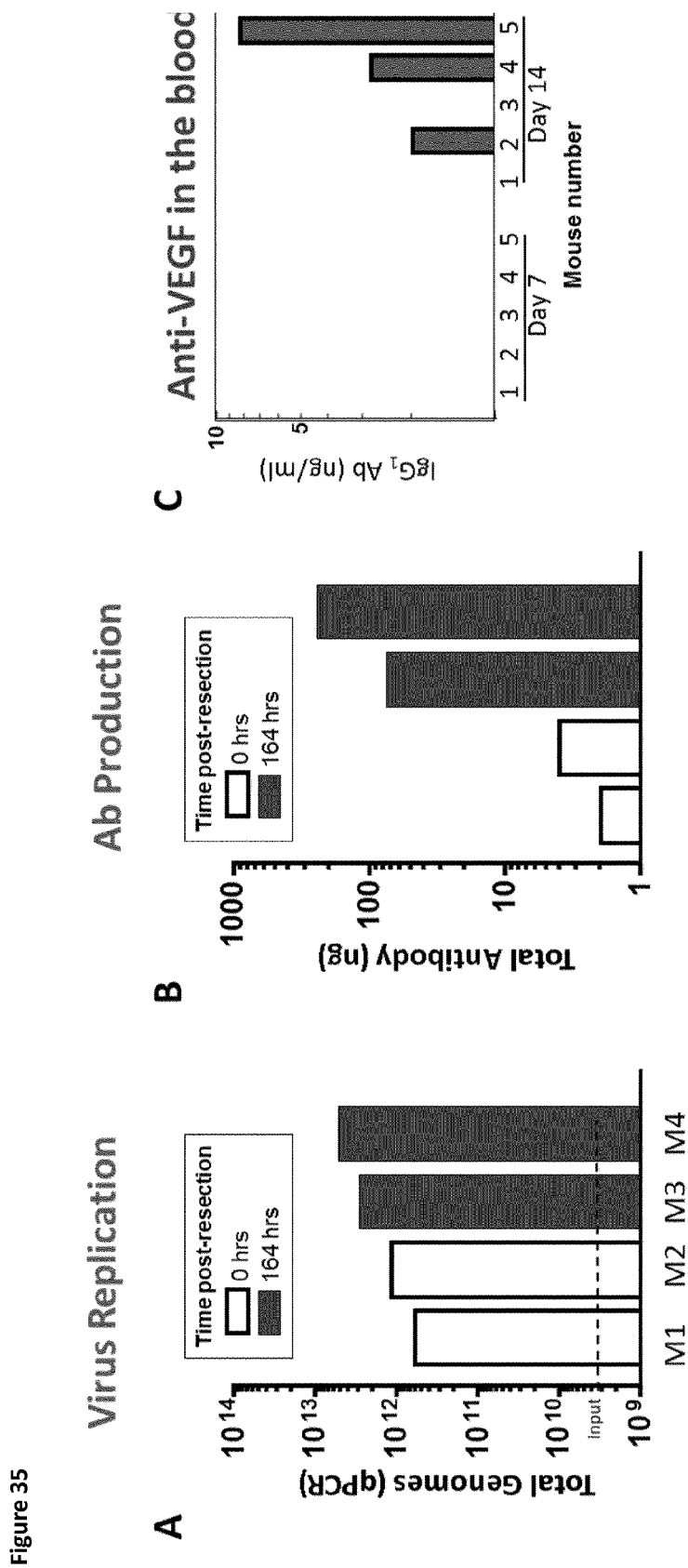

FIG. 35 shows NG-135 virus replication and anti-VEGF antibody expression in ex vivo cultured explants of HCT-116 subcutaneous xenograft tumours infected in vivo by IT dosing. HCT-116 human colon carcinoma cells were implanted as a subcutaneous xenograft in CD1 nu/nu mice and the established tumour injected with $5 \times 10^9$ NG-135 virus particles. 10 days later tumours were excised and tested for levels of virus genome (A) and anti-VEGF antibody (B) before or after 7 days of ex vivo culture. Anti-VEGF antibody levels in sera.

Figure 36:
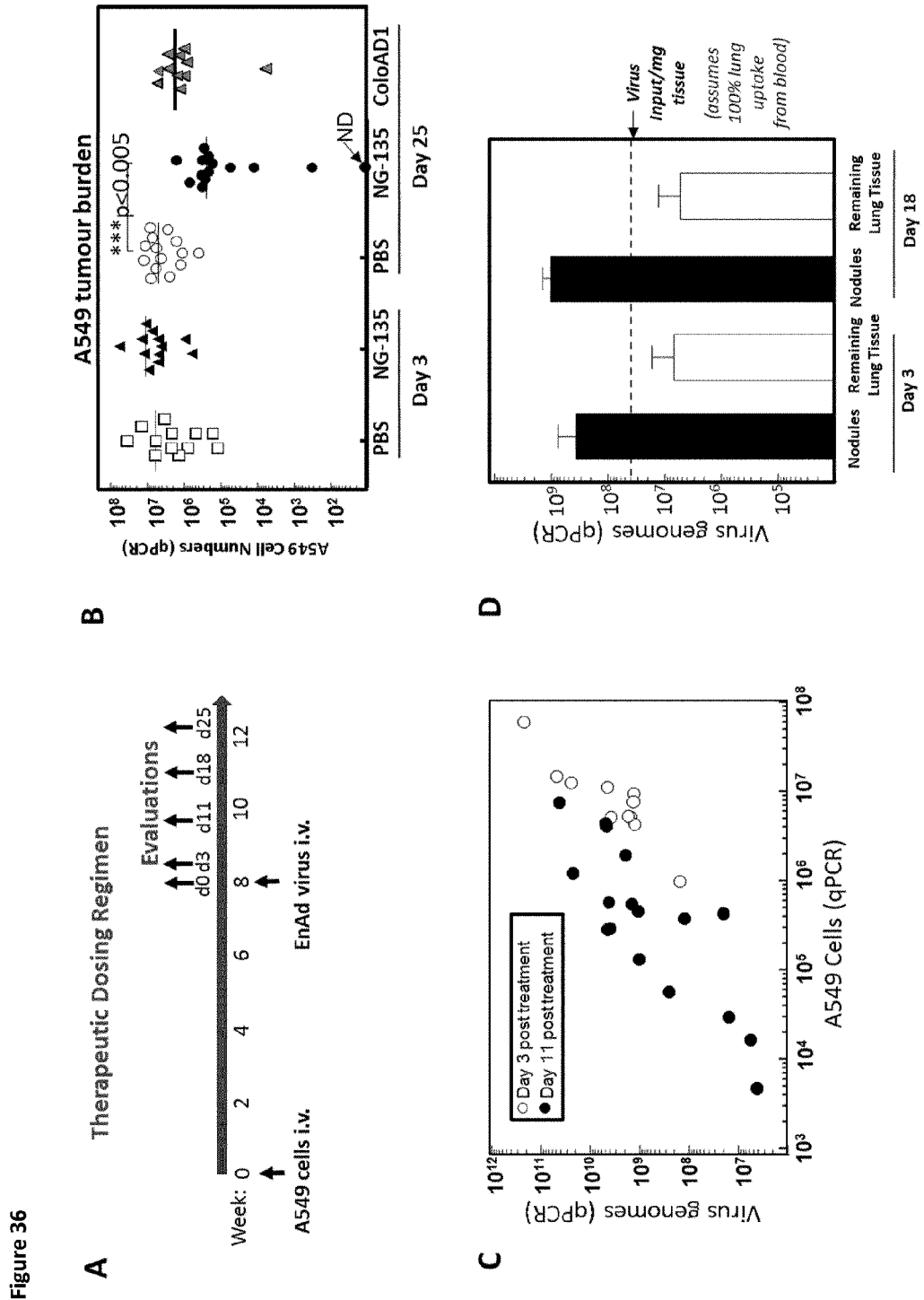

FIG. 36 shows NG-135 virus replication and effect on tumour tissues in an in vivo A549 cell lung tumour model in mice. Human A549 cells were injected intravenously into SCID mice to form nodular tumours in the lungs. At 8 weeks, when tumours were established, EnAd or NG-135 viruses (5e9 particles) were injected intravenously and effects on the tumours were monitored at different time points. The dosing regimen is shown in (A). The effect of NG-135 on tumour burden in the lungs (as measured by qPCR for the human gene PTGER2) is shown for different mice at days 3 and 25 after dosing in (B). (C) shows levels of virus genomes (qPCR) correlated with levels of tumour (human PTGER2 qPCR). Lungs dissected into visible tumour nodules and remaining lung tissue were also assessed for levels of virus genome (D).

Figure 37:
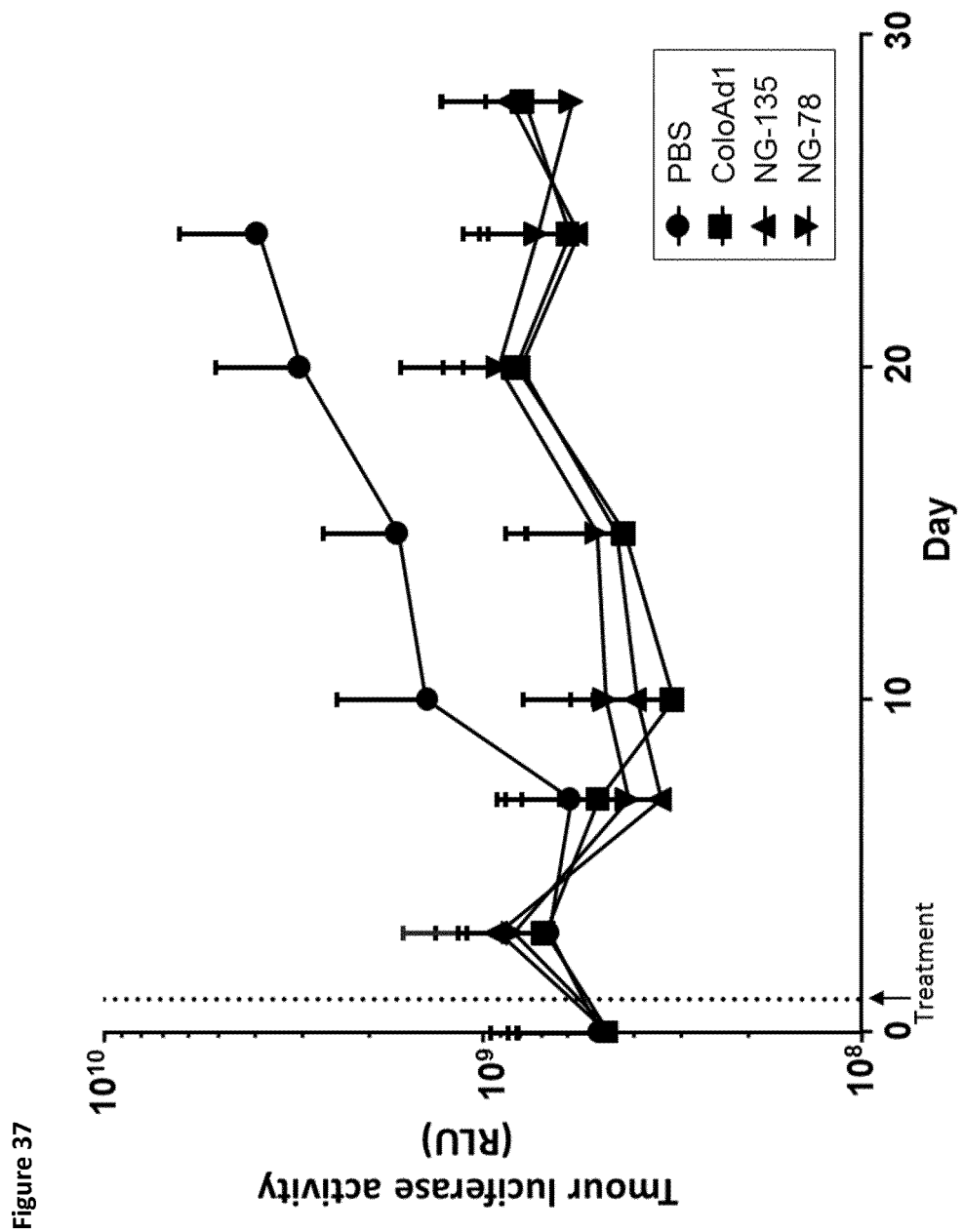

FIG. 37 shows NG-135 and EnAd activity in a murine orthotopic xenograft model of ovarian cancer using human SKOV-3 ovarian carcinoma cells stably expressing luciferase implanted into CB17-SCID mice via intraperitoneal injection (5e6 cells/mouse). 22 days post implantation mice were treated with either PBS (control) or 5e7 EnAd, NG-135 or NG-78 virus particles delivered by intraperitoneal injection and tumour growth monitored as luciferase activity over time.

FIG. 38 shows characterisation of the NG-135 virus and expressed anti-VEGF antibody following scaled-up production and purification of virus material from HEK293 cells cultured in a bioreactor. NG-135 was comparable in potency (A) and replication (B) to an EnAd virus standard, with increasing antibody levels detected in culture supernatants over time (C). Western blot (D) and Biacore (E) characterization of purified antibody show comparability to commercially manufactured anti-VEGF antibody (Avastin).

Figure 39:
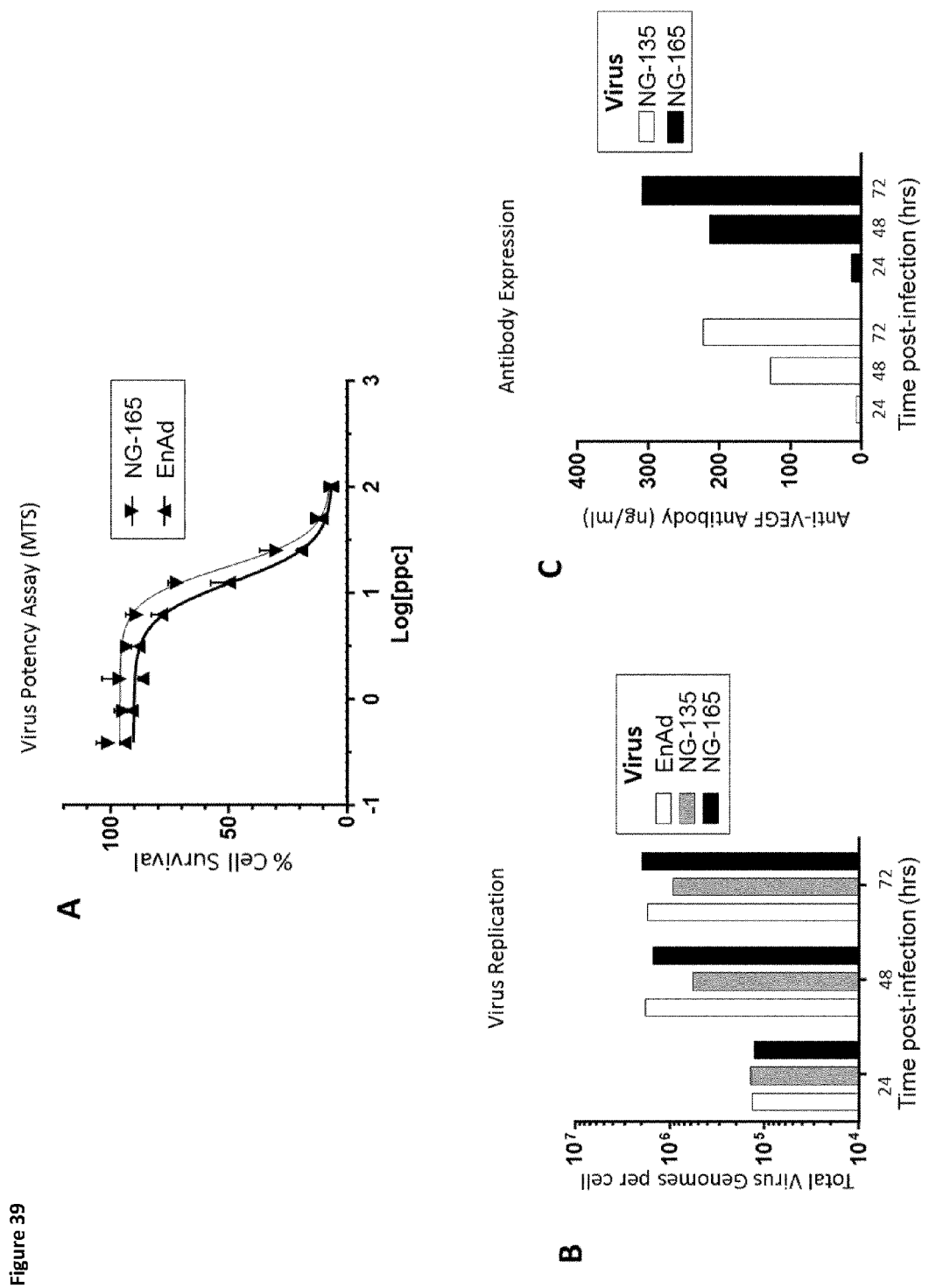

FIG. 39 shows production and characterisation of EnAd viruses encoding anti-VEGF antibody H & L chains linked by a self-cleavable P2A peptide (NG-165), with comparative data for virus potency (A), replication (B) and anti-VEGF antibody production to EnAd and NG-135 (C).

Figure 40:
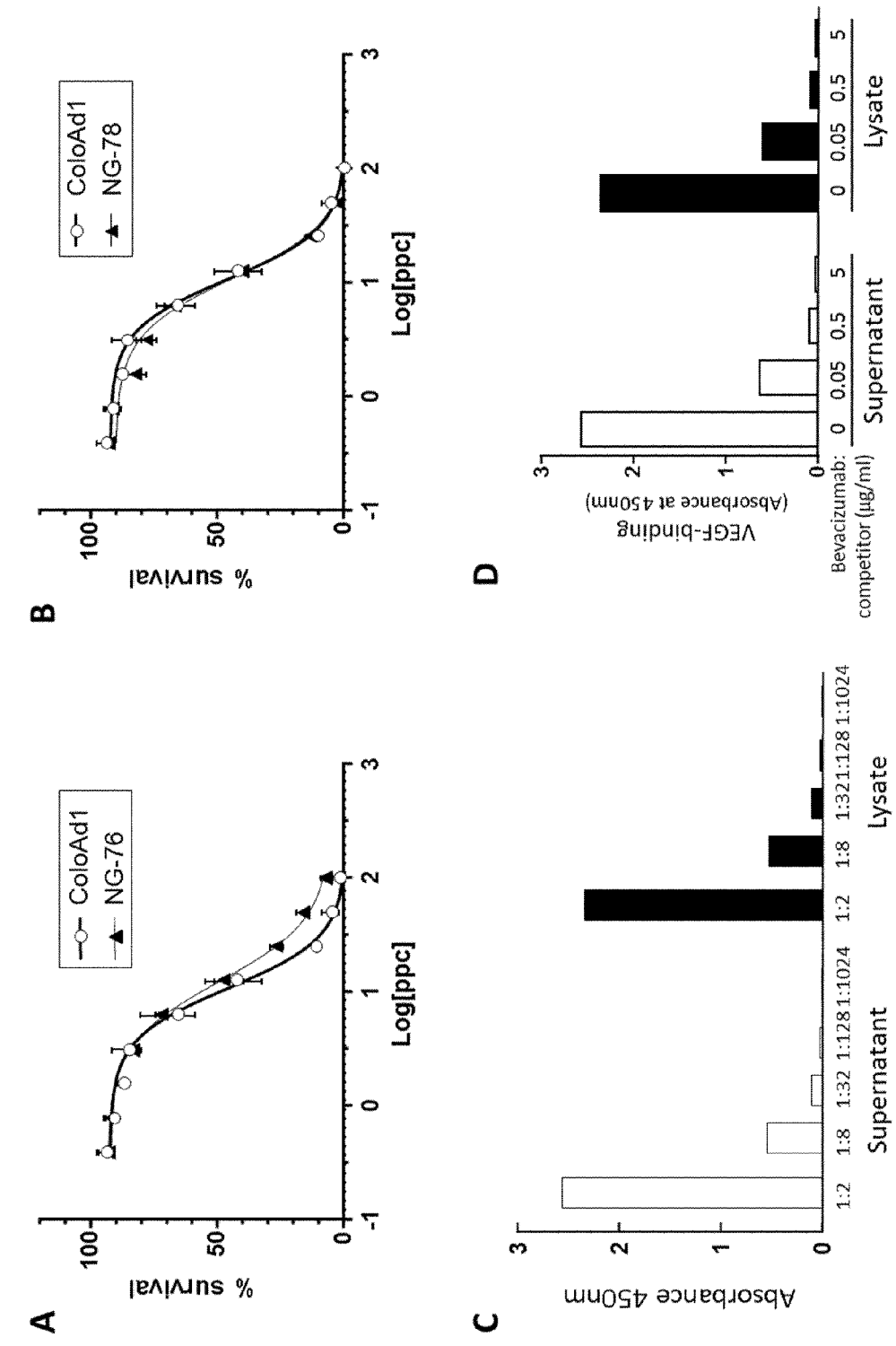

FIG. 40 shows characterisation of EnAd viruses NG-76 and NG-78 encoding anti-VEGF antibody ScFvs under control of endogenous or exogenous promoters. Both viruses showed similar oncolytic potency to standard EnAd virus (A & B). For NG-78, direct binding activity of ScFv to VEGF in both supernatant and cell lysate fractions is shown in (C), and competition for VEGF binding by commercial anti-VEGF antibody (bevacizumab) is shown in (D).

Figure 41:
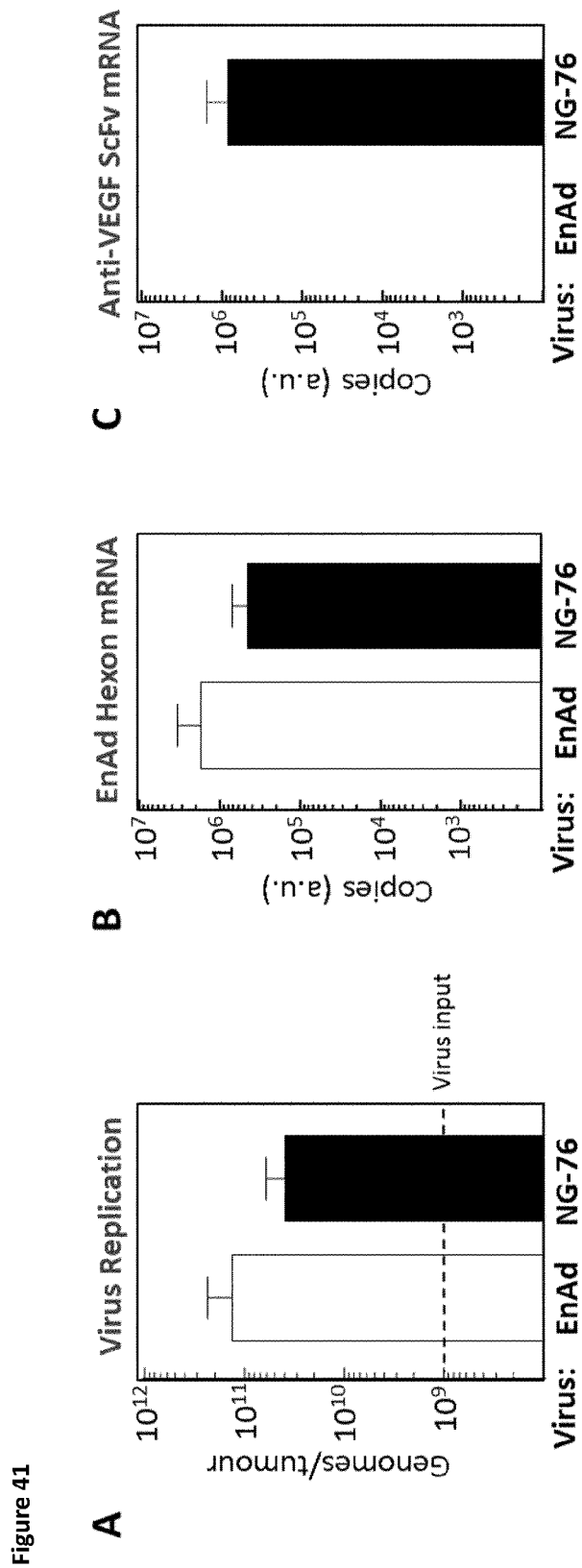

FIG. 41 shows a comparison of NG-76 virus activity to EnAd in tumour-bearing mice, with virus replication (A), hexon mRNA (B) and ScFv mRNA (C) being measured.

Figure 42:
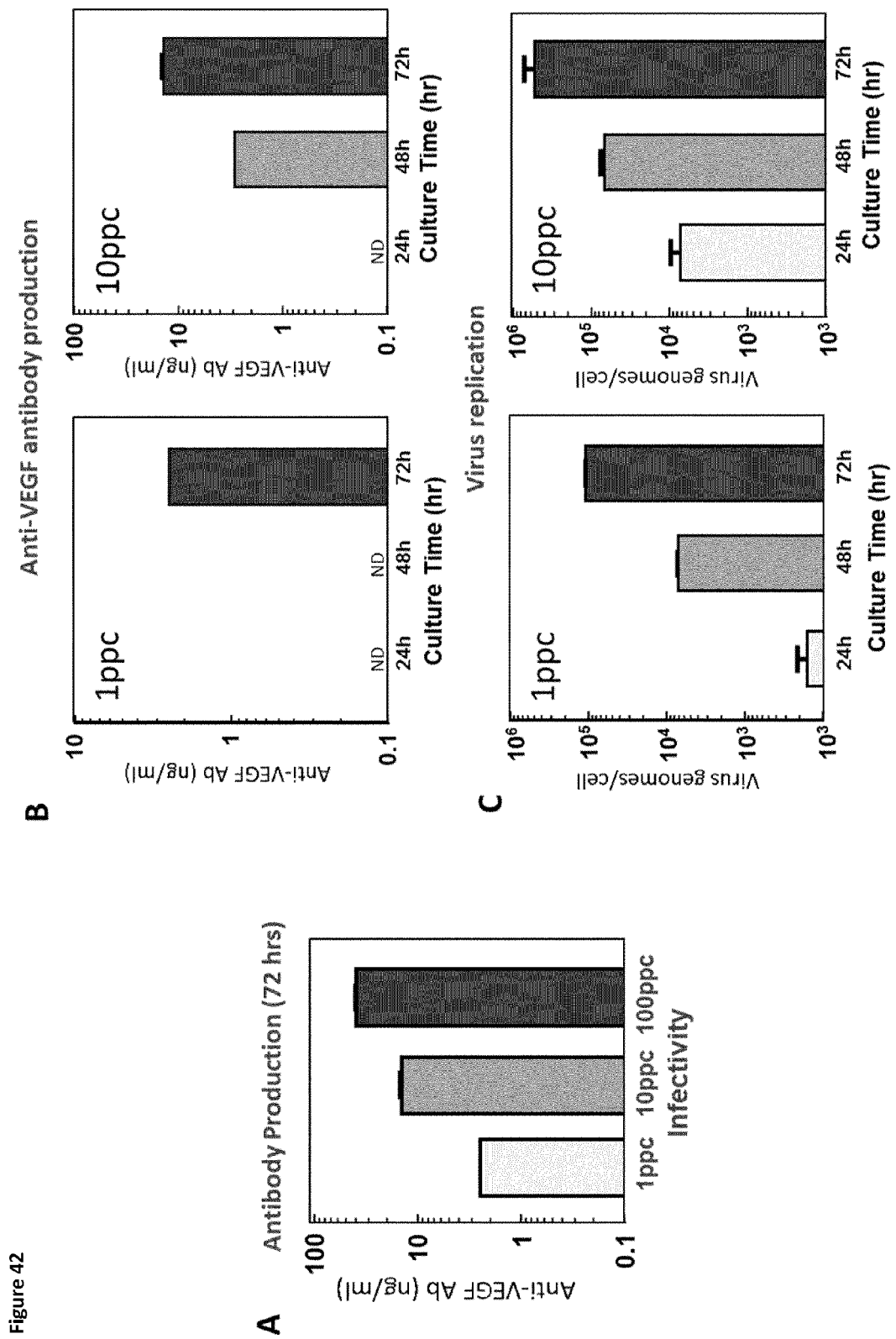

FIG. 42 shows the time course of both replication and expression of antibody by NG-135 in HT-29 cells. Secreted antibody was detectable at 72 hours for all MOIs tested, but the level of antibody expression is dependent on input MOI (A). Antibody production and replication at 24, 48 and 72 hours following infection with either 1 or 10 virus ppc are shown in (B-D).

Figure 43:
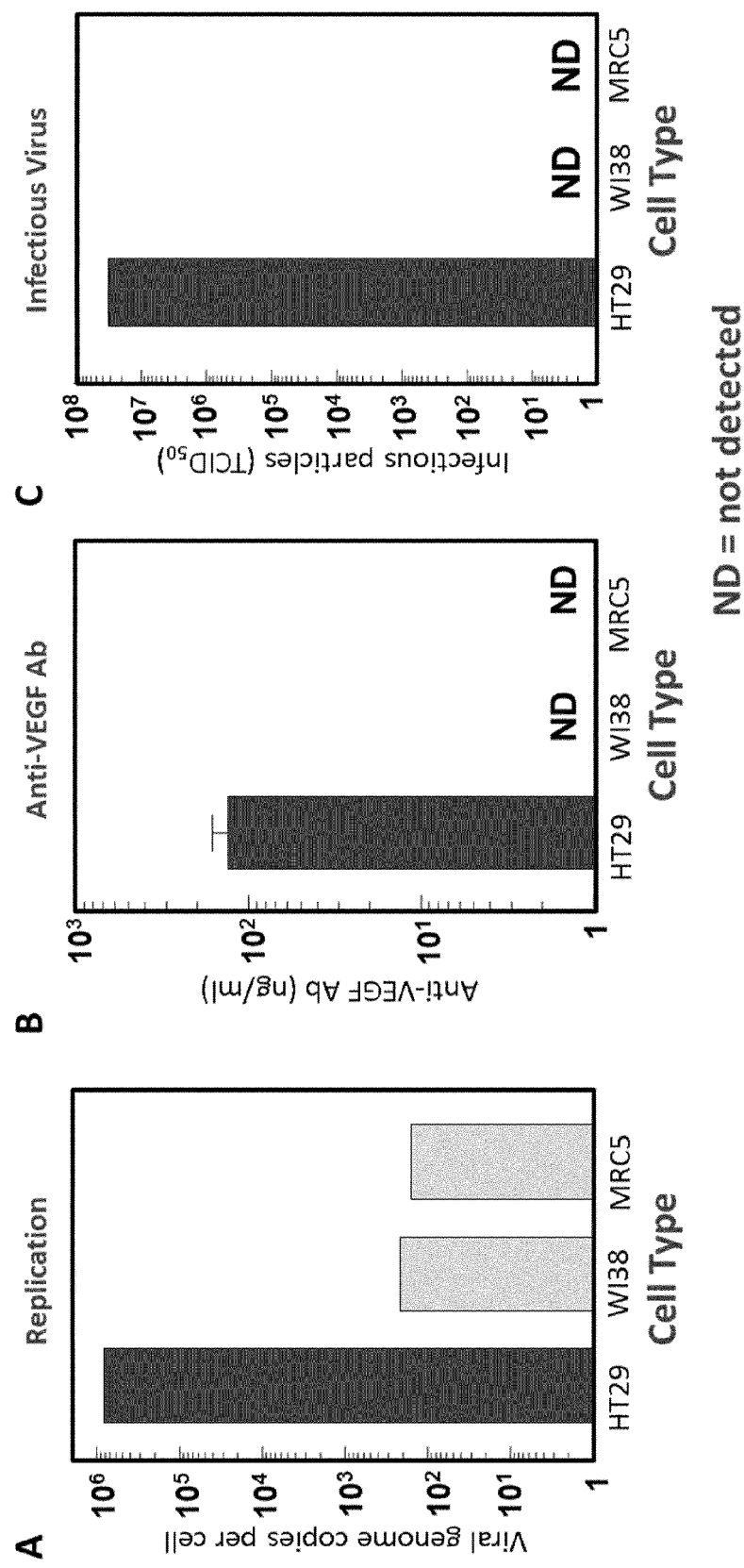

FIG. 43 shows NG-135 replication (A), anti-VEGF antibody (B) and production of infectious virus particles (C) in HT-29 carcinoma and WI38 and MRCS, stromal fibroblast cells.

Figure 44:
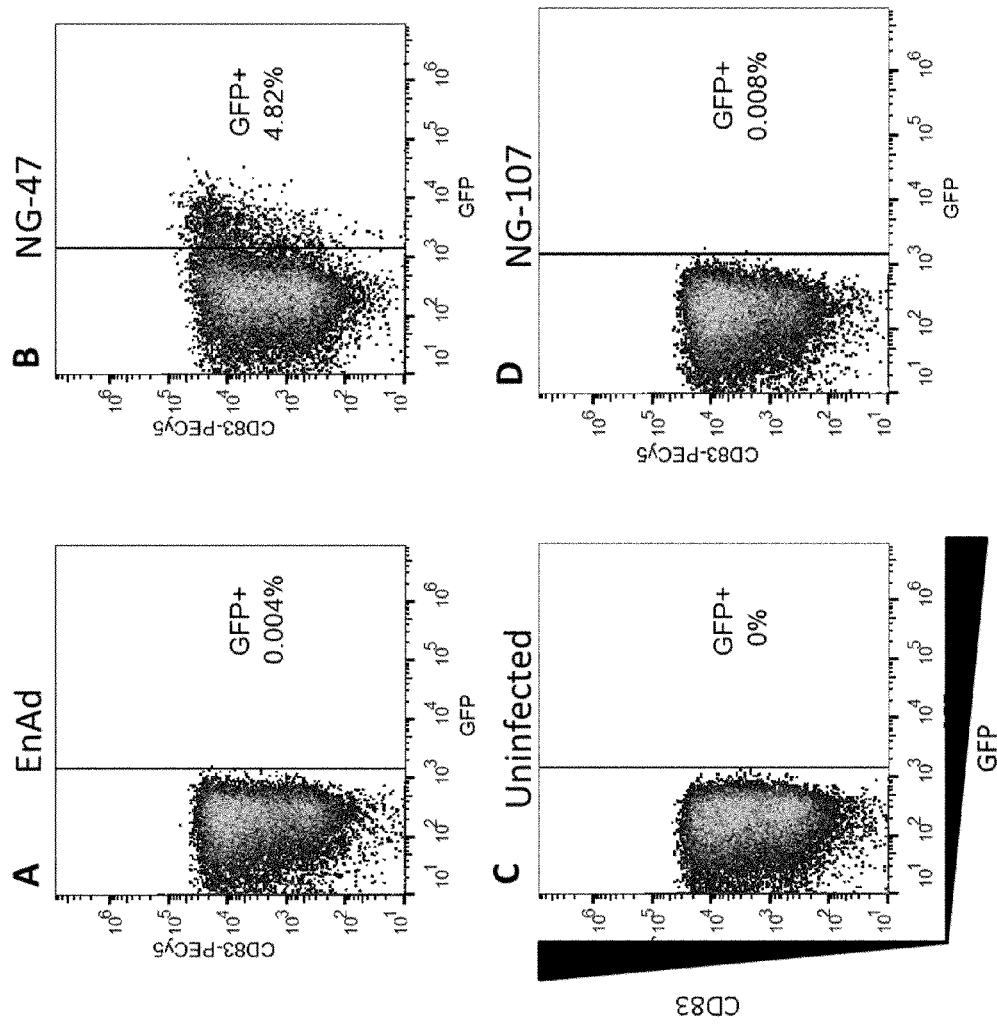

FIG. 44 shows selective expression of an eGFP reporter transgene expressed under the control of an exogenous (CMV) promoter (NG-47) shown in (B) or the endogenous MLP (NG-107) shown in (D) in primary human dendritic cells. eGFP reporter transgene expression for dendritic cells exposed to EnAd is shown in (A) and for uninfected control cells is shown in (C).

Figure 45:
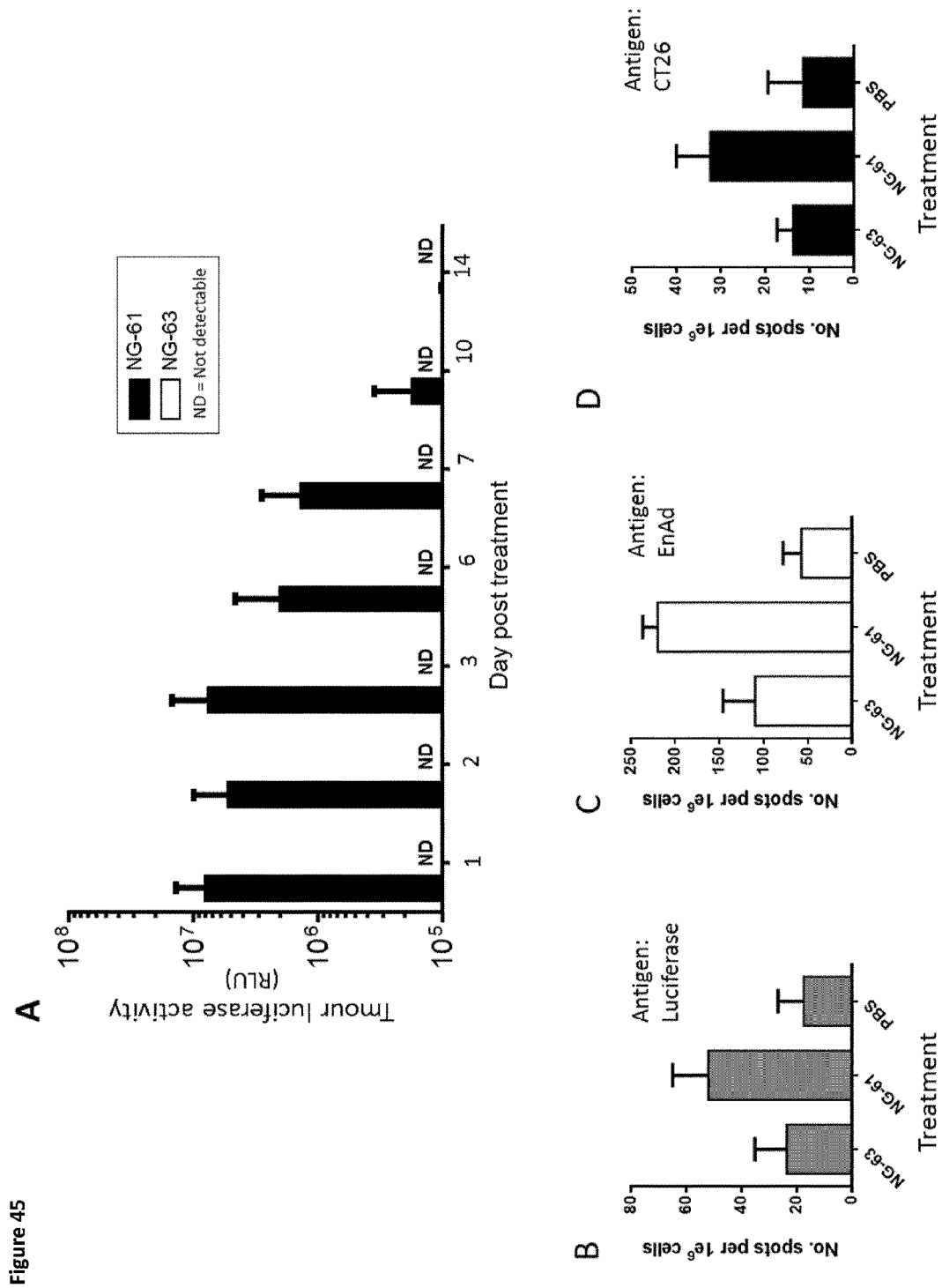

FIG. 45 shows luciferase transgene expression in tumours and the functional immune response to the transgene, virus or tumour in BALB/c mice when transgene expression was under the control of either an exogenous (CMV) promoter (NG-61) or the endogenous MLP promoter (NG-63). CT-26 tumours grown on the flank of immunologically intact BALB/c mice were injected intra-tumourally with either of the viruses and luciferase expression monitored by luminescent imaging over time (A) and T-cell responses to luciferase (B), EnAd (C) or tumour (D) antigens were measured by ELISPOT assay.

Figure 46:
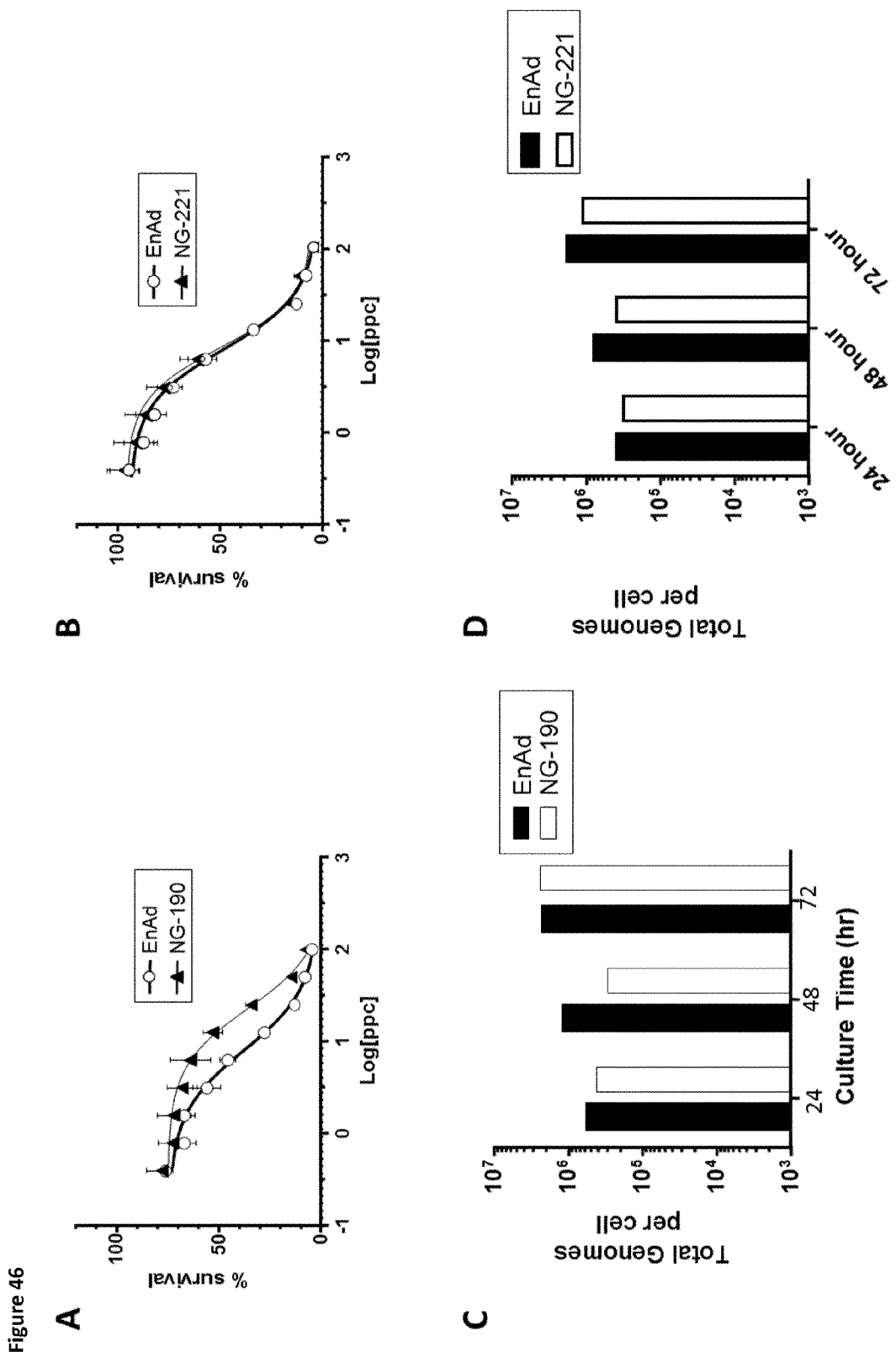

FIG. 46 shows virus oncolytic potency (A,B) and replication (C,D) of viruses encoding antibodies (NG-190) or ScFv antibody variant (NG-221) to the immune-checkpoint inhibitor pathway protein PD-L1, with comparison to EnAd virus as standard comparator.

Figure 47:
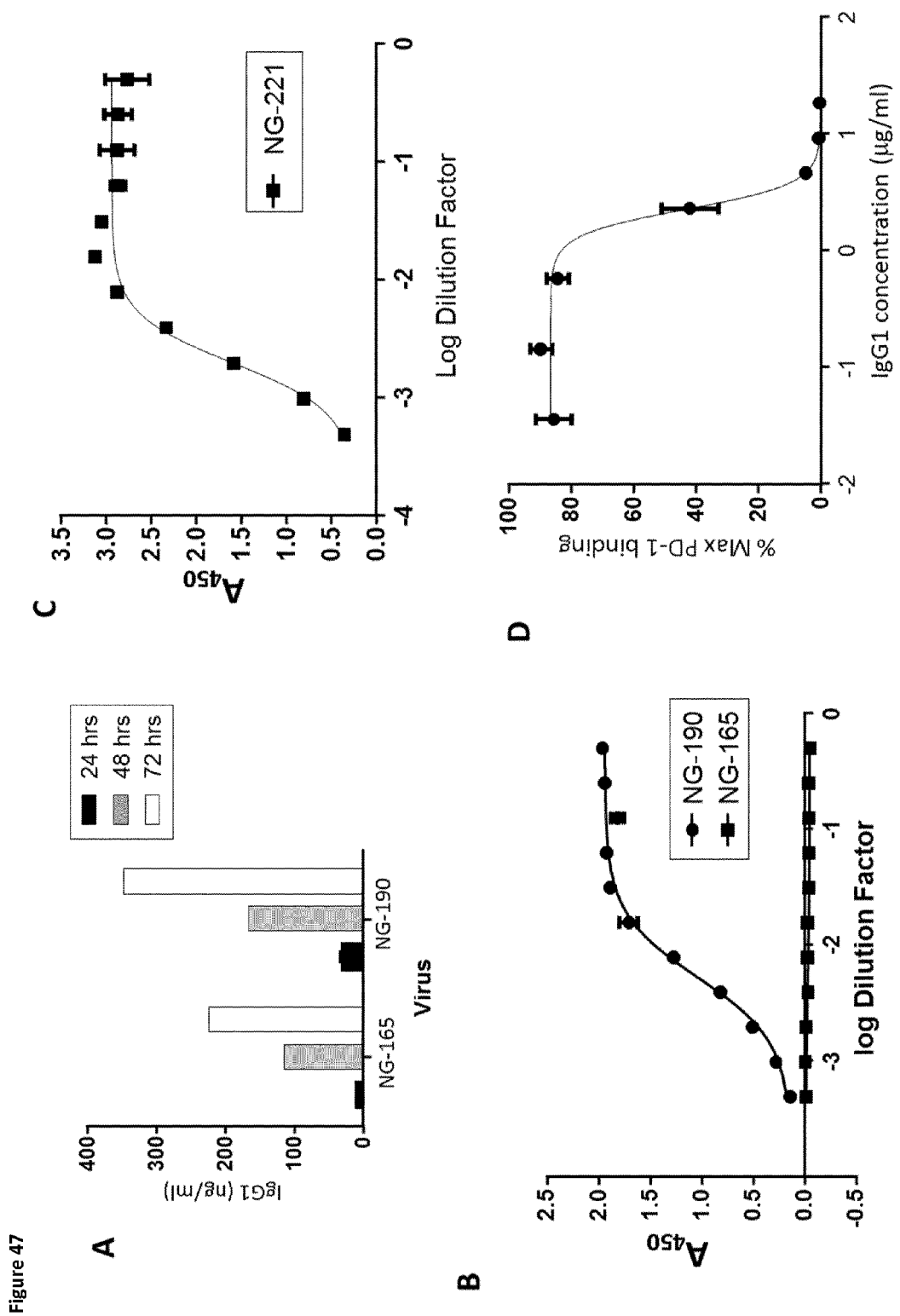

FIG. 47 shows characterization of anti-PD-L1 antibody or ScFv production (A) and PD-L1 ligand binding activities (B, C, D) in supernatants of NG190 and NG-221 infected HT-29 cells, with comparison to IgG1 production and binding for NG-165 producing anti-VEGF IgG1 antibody as specificity control.

Figure 48:
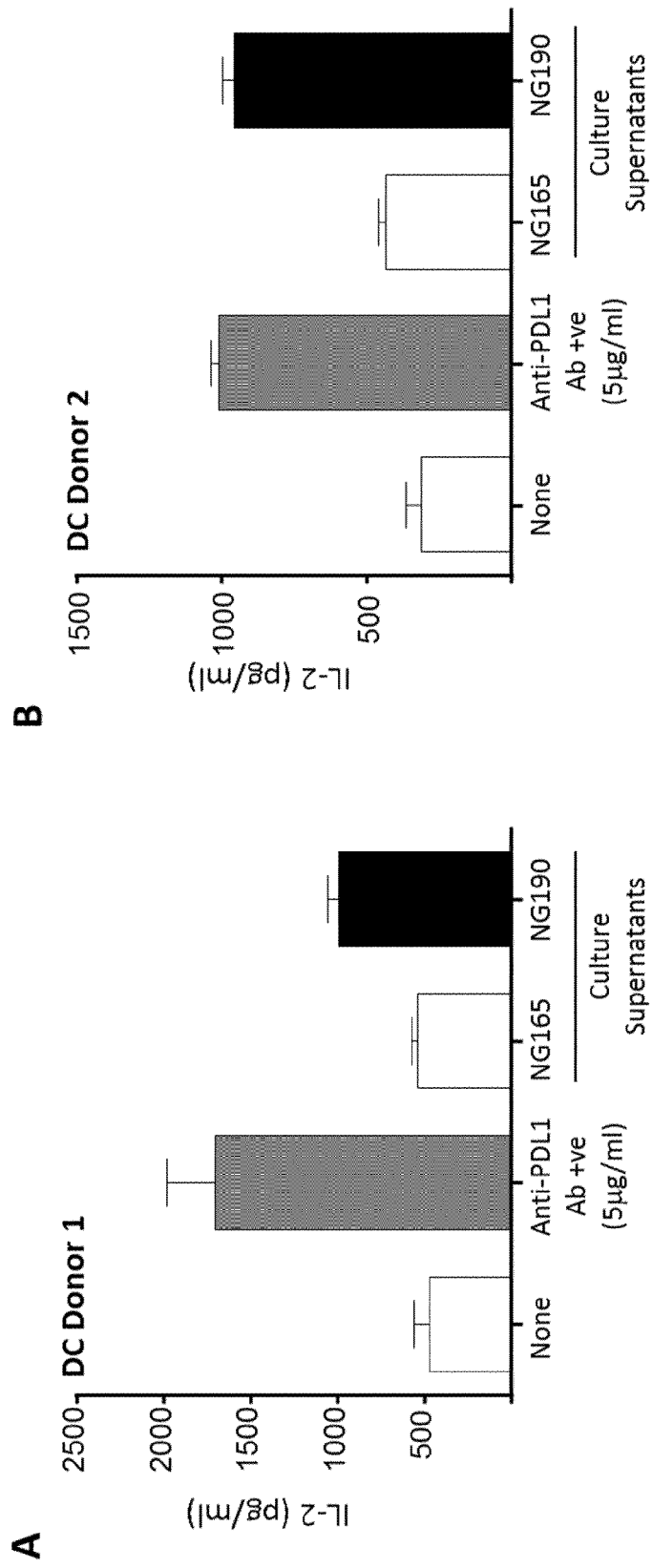

FIG. 48 shows the functional activity of anti-PD-L1 antibody expressed in the supernatant of NG-190 infected A549 cells was assessed by the extent of T cell activation in a mixed lymphocyte reaction, measured as IL-2 in culture supernatants. Dendritic cells differentiated from PBMCs of two different donors were used as stimulator cells with CD4 T-cells purified from a third donor. Enhancement of the T-cell response by NG-190 supernatants is compared to that for a purified anti-PDL1 monoclonal antibody and supernatants from NG-165 cultures.

Figure 49:
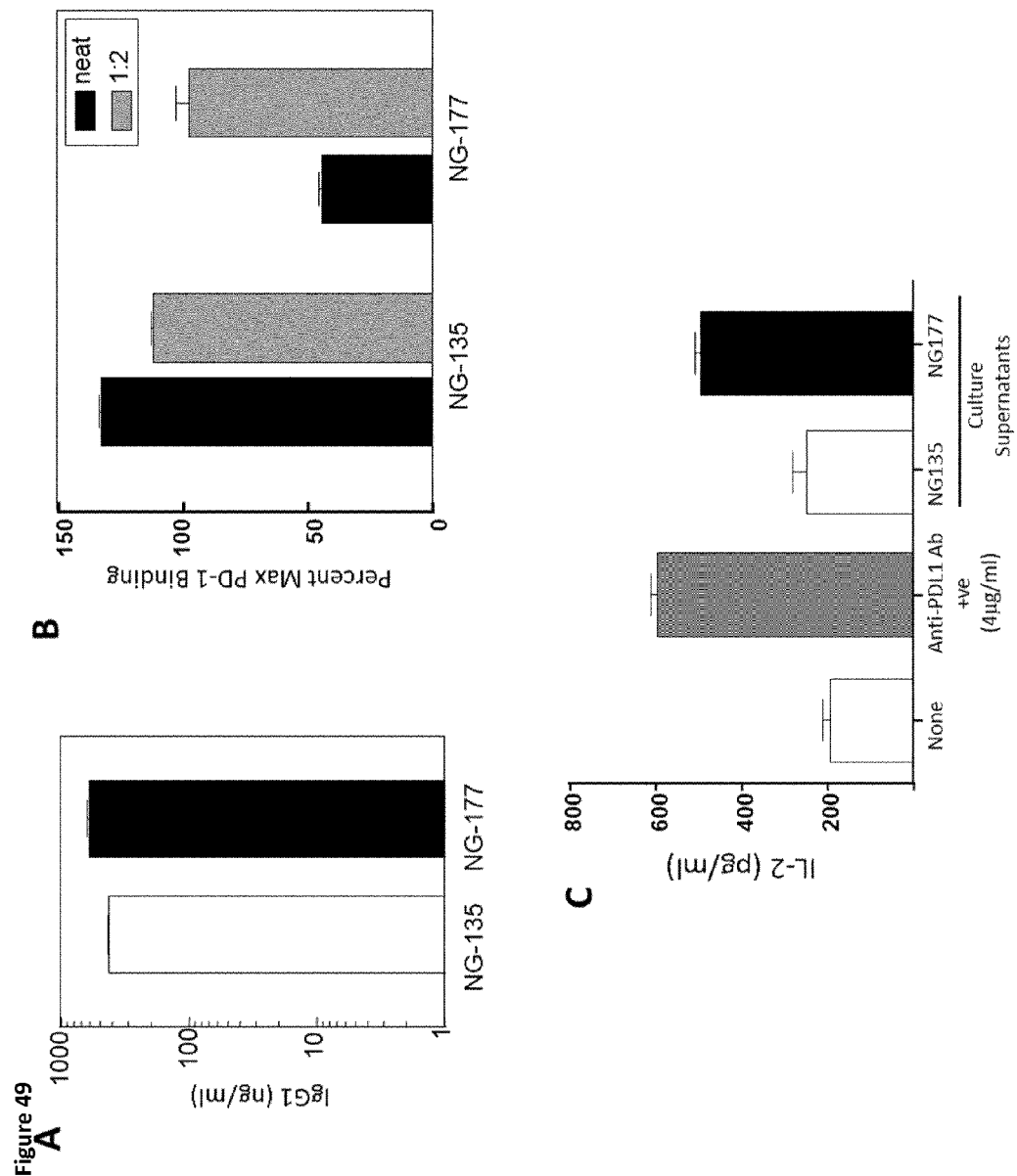

FIG. 49 shows the functional activity of anti-PD-L1 antibody expressed in the supernatant of NG-177 infected 293 cells in comparison to NG-135 as antibody specificity control. Both viruses produced similar IgG1 levels in 293 cells (A). NG-177 supernatants selectively inhibited binding of PD-L1 to its ligand PD1 compared to NG-135 (B), and these same NG-177 supernatants were able to enhance IL-2 production in an MLR assay, with purified monoclonal anti-PD-L1 as positive control (C).

Figure 50:
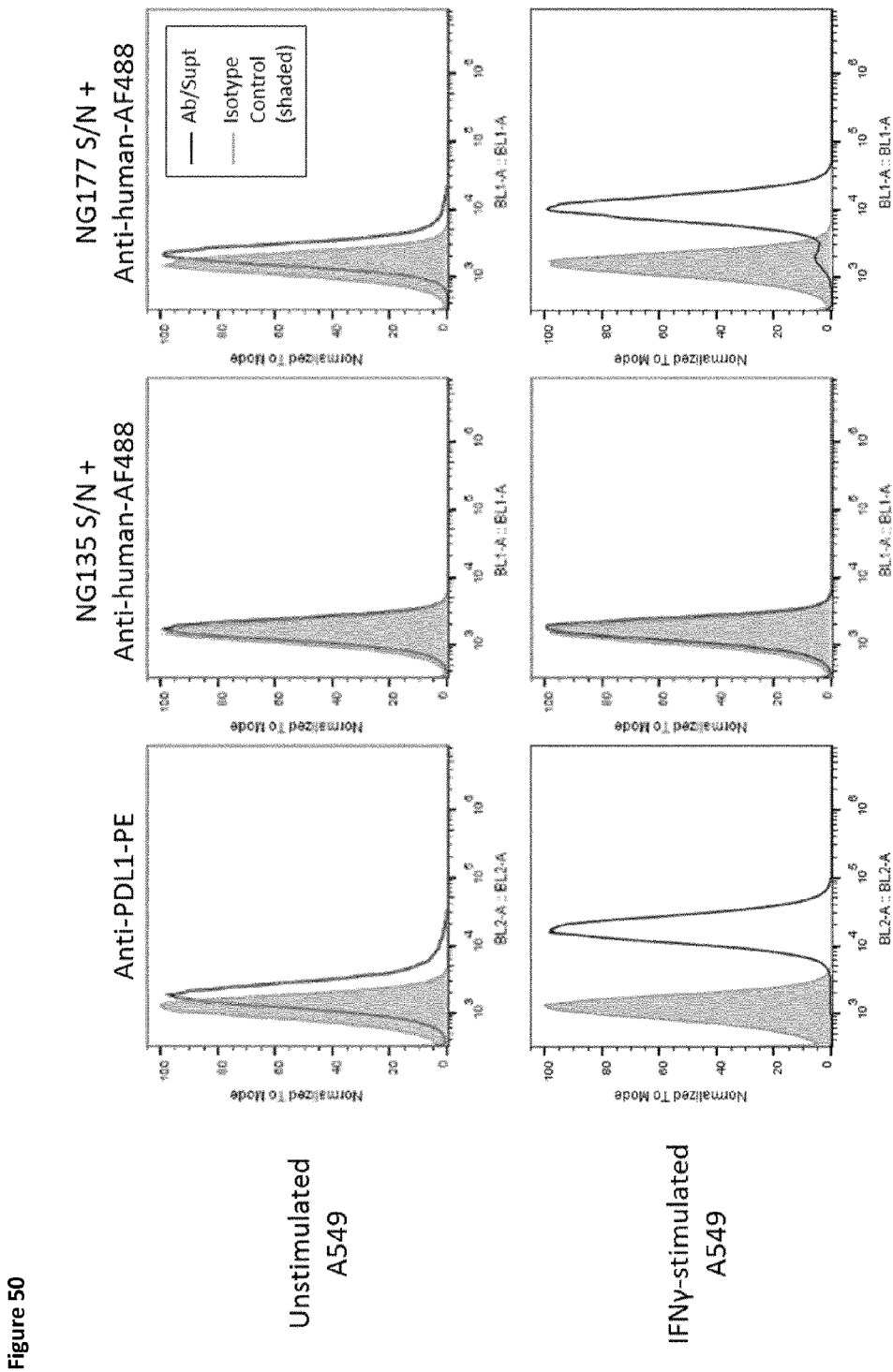

FIG. 50 shows FACS analysis of cellular PD-L1 binding activity of NG-177 supernatants on IFNg stimulated A549 cells, comparing to binding of purified monoclonal anti-PD-L1 antibody and NG-135 supernatants.

Figure 51:
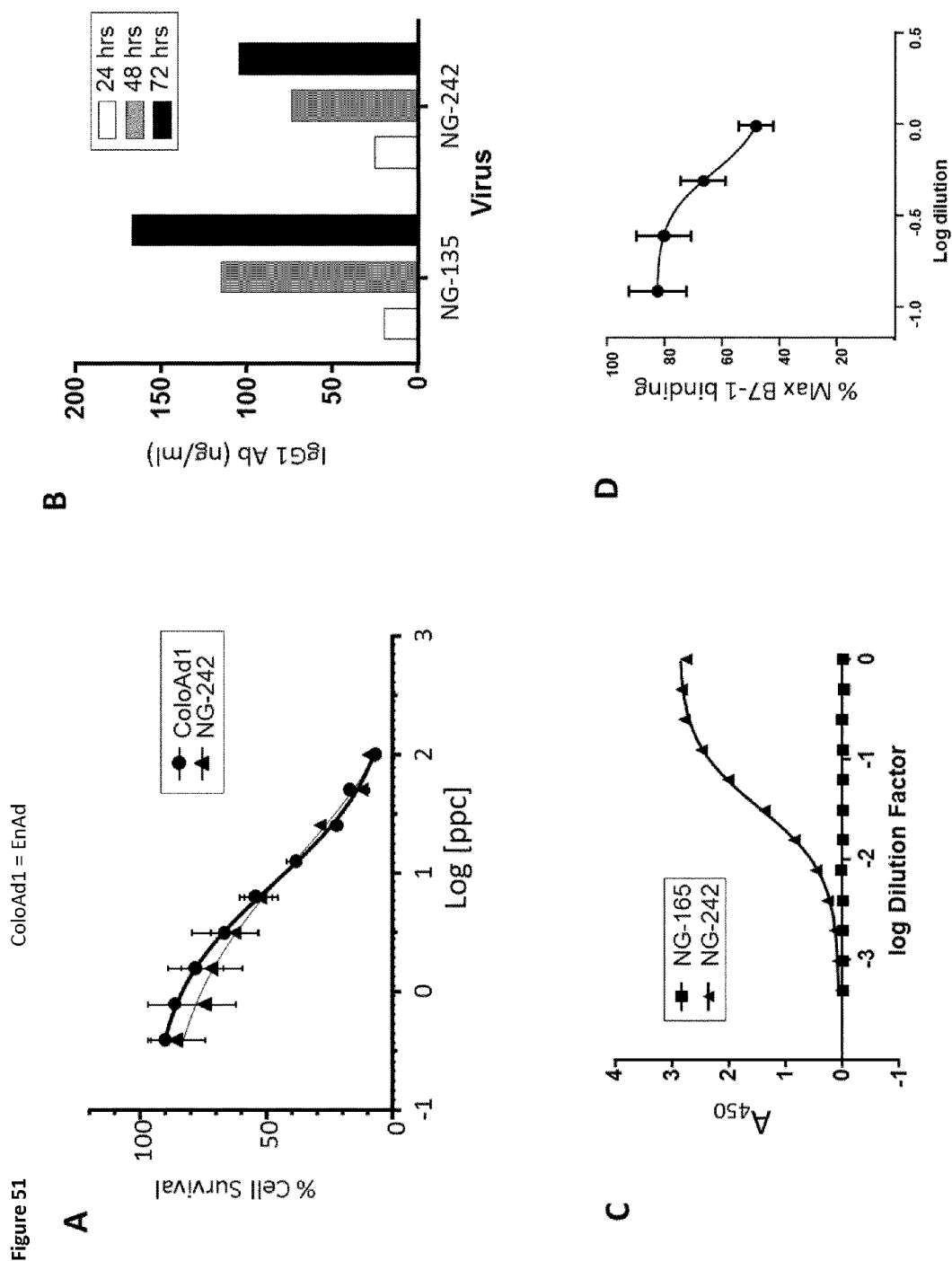

FIG. 51 shows characterisation of EnAd virus encoding antibody to the immune-checkpoint inhibitor pathway protein CTLA-4 (NG-242). Virus replication was comparable to EnAd control (A). IgG1 production by NG-242 was comparable to NG-135 (B). Functional activity of the anti-CTLA4 antibody in NG242 supernatants was shown by direct ligand binding (C), comparing to NG-165 control supernatants, as well as by inhibition of recombinant CTLA4-Fc binding to its ligand B7-1 (D) in ELISA experiments.

Figure 52:
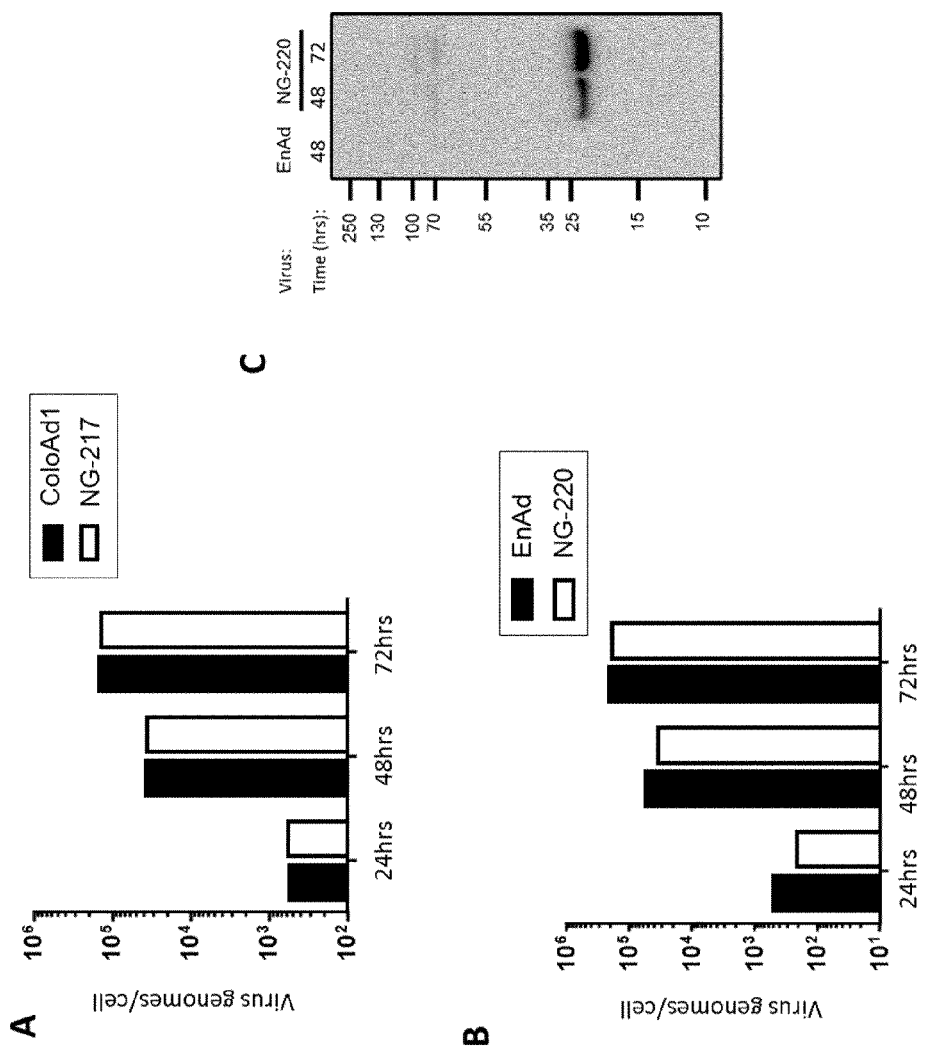

FIG. 52 shows characterisation of viruses encoding the tumour associated antigen TAA, NY-ESO-1 (NG-220). Virus replication for NG-220 (A) or NG-217 (B) was comparable to EnAd control. NY-ESO-1 could be detected by western blot in the lysate of NG-220 infected cells but not in EnAd control cells (C).

FIG. 53 shows charactersiation of EnAd virus with inserted unique restriction sites in regions Bx and By of the genome (NG-185). Virus oncolytic activity compared by cell viability assay (A) and virus replication (B) was comparable to EnAd control.

Figure 54:
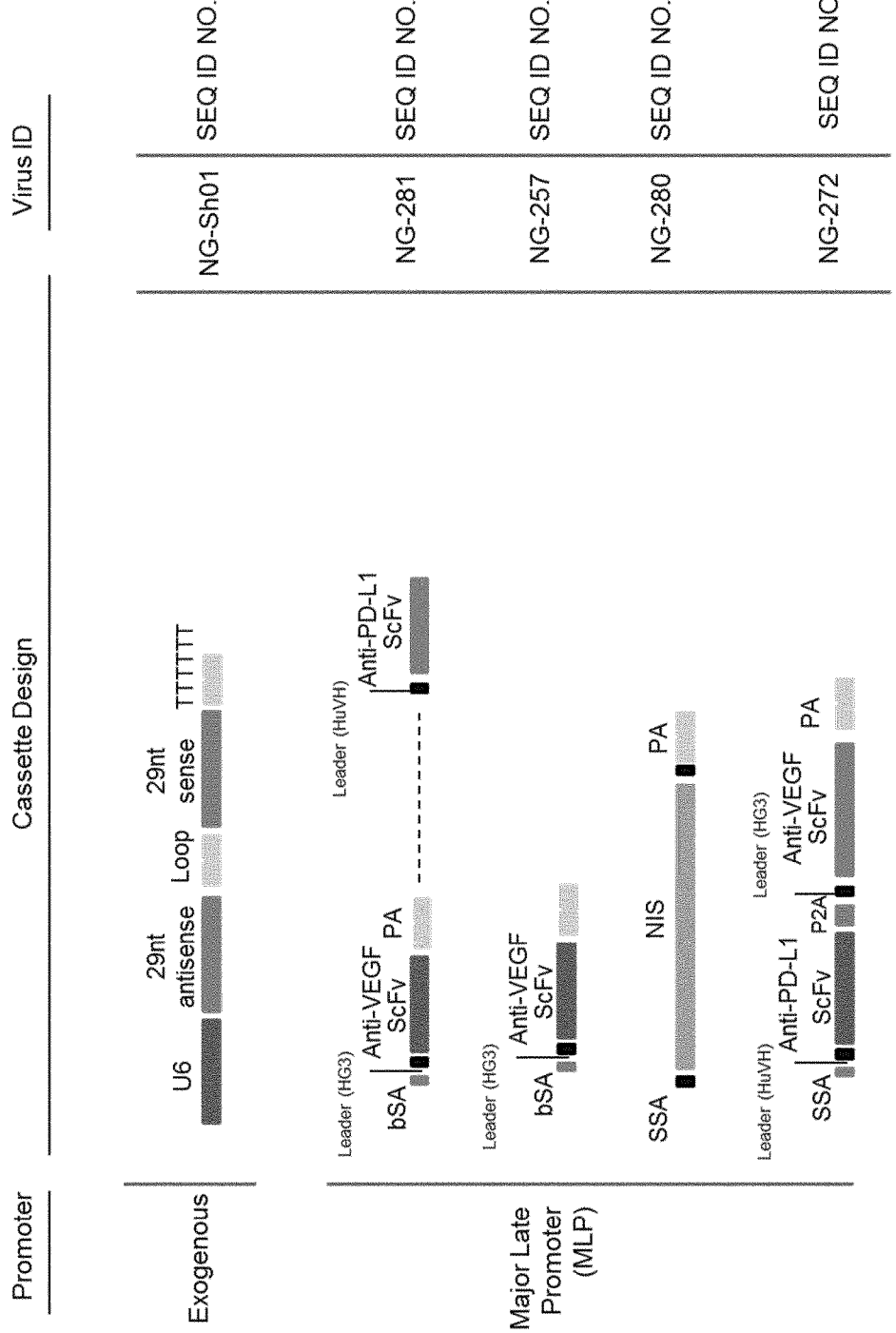

FIG. 54 shows schematics of transgene cassettes encoding a multiple ScFvs, shRNAs or the sodium iodide symporter protein.

SEQUENCES

SEQ ID NO: 1 NG-77 virus genome sequence comprising the EnAd genome with a transgene cassette that encodes an anti-VEGF full length antibody inserted in the region $B_Y$. The transgene cassette contains a 5' branched splice acceptor sequence (bSA), ab heavy chain sequence with 5' leader, an IRES, an ab light chain sequence with 5' leader and a 3' poly(A) sequence.

SEQ ID NO: 2 NG-135 virus genome sequence comprising the EnAd genome with a transgene cassette that encodes an anti-VEGF full length antibody inserted in the region $B_Y$. The transgene cassette contains a 5' short splice acceptor sequence (SSA), ab heavy chain sequence with 5' leader, an IRES, ab light chain sequence with 5' leader and 3' poly(A) sequence.

SEQ ID NO: 3 A virus genome sequence comprising a transgene cassette that encodes an anti-VEGF full length antibody inserted in the region $B_Y$. The transgene cassette contains a SSA, ab heavy chain sequence with 5' leader, a SSA, and ab light chain sequence with 5' leader.

SEQ ID NO: 4 A virus genome sequence comprising a transgene cassette that encodes an anti-VEGF full length antibody inserted in the region $B_Y$. The transgene cassette contains a SSA, ab heavy chain sequence with 5' leader, a SSA, ab light chain sequence with 5' leader and 3' poly(A) sequence.

SEQ ID NO: 5 NG-74 virus genome sequence comprising the EnAd genome with a transgene cassette that encodes an anti-VEGF ScFv inserted in the region $B_Y$. The transgene cassette contains a bSA, anti-VEGF ScFv sequence with 5' leader and 3' poly(A) sequence.

SEQ ID NO:6 NG-78 virus genome sequence comprising the EnAd genome with a transgene cassette that encodes an anti-VEGF ScFv with a C-terminal His6 tag, inserted in the region $B_Y$. The transgene cassette contains a bSA, anti-VEGF ScFv sequence with 5' leader and 3' 6×histidine sequence and a poly(A) sequence.

SEQ ID NO: 7 NG-76 virus genome sequence comprising the EnAd genome with a transgene cassette that encodes an anti-VEGF ScFv with a C-terminal His6 tag, inserted in the region $B_Y$. The transgene cassette contains a CMV promoter, anti-VEGF ScFv sequence with 5' leader and 3' 6× histidine sequence and a poly(A) sequence.

SEQ ID NO: 8 NG-73 virus genome sequence comprising the EnAd genome with a transgene cassette that encodes an anti-VEGF ScFv inserted in the region $B_Y$. The transgene cassette contains a CMV promoter, anti-VEGF ScFv sequence with 5' leader and 3' poly(A) sequence.

SEQ ID NO: 9 NG-134 virus genome sequence comprising the EnAd genome with a transgene cassette encoding an anti-VEGF full length antibody inserted into the region $B_Y$. The transgene cassette contains a CMV promoter, ab heavy chain sequence with 5' leader, an IRES, ab light chain sequence with 5' leader and a 3' poly(A) sequence.

SEQ ID NO: 10 $B_X$ DNA sequence corresponding to and including by 28166-28366 of the EnAd genome.

SEQ ID NO: 11 By DNA sequence corresponding to and including by 29345-29379 of the EnAd genome.

SEQ ID NO: 12 EnAd genome.
SEQ ID NO: 13 CMV exogenous promoter.
SEQ ID NO: 14 PGK exogenous promoter.
SEQ ID NO: 15 CBA exogenous promoter.
SEQ ID NO: 16 Short splice acceptor (SSA). Null sequence
SEQ ID NO: 17 splice acceptor (SA).
SEQ ID NO: 18 branched splice acceptor (bSA).
SEQ ID NO: 19 Internal Ribosome Entry sequence (IRES).
SEQ ID NO: 20 polyadenylation sequence.
SEQ ID NO: 21 Leader sequence (HuVH).
SEQ ID NO: 22 Leader sequence (HG3).
SEQ ID NO: 23 Histidine tag.
SEQ ID NO: 24 V5 tag.

SEQ ID NO: 25 P2A peptide.
SEQ ID NO: 26 F2A peptide.
SEQ ID NO: 27 E2A peptide.
SEQ ID NO: 28 T2A peptide.
SEQ ID NO: 29 anti-VEGF ab VH chain amino acid sequence.
SEQ ID NO: 30 anti-PD-L1 antibody VH chain amino acid sequence.
SEQ ID NO: 31 anti-VEGF ab VL chain amino acid sequence.
SEQ ID NO: 32 anti-PD-L1 antibody VL chain amino acid sequence.
SEQ ID NO: 33 human IgG1 constant heavy chain amino acid sequence.
SEQ ID NO: 34 human IgG1 modified constant heavy chain amino acid sequence.
SEQ ID NO: 35 human kappa constant light chain amino acid sequence.
SEQ ID NO: 36 anti-VEGF ScFv amino acid sequence.
SEQ ID NO: 37 anti-PD-L1 ScFv amino acid sequence.
SEQ ID NO: 38 Green fluorescent protein amino acid sequence.
SEQ ID NO: 39 Luciferase amino acid sequence.
SEQ ID NO: 40 Human Tumour necrosis factor alpha (TNFα) amino acid sequence.
SEQ ID NO: 41 Human Interferon gamma (IFNγ) amino acid sequence.
SEQ ID NO: 42 Human Interferon alpha (IFNα) amino acid sequence.
SEQ ID NO: 43 human cancer/testis antigen 1 (NY-ESO-1) amino acid sequence.
SEQ ID NO: 44 human MUC-1 amino acid sequence.
SEQ ID NO: 45 A Kozak sequence. gccaccatg (Null sequence)
SEQ ID NO: 46 NG-177 virus genome sequence comprising the EnAd genome with a transgene cassette encoding an anti-PD-L1 full length antibody inserted into the region $B_Y$. The transgene cassette contains a CMV promoter, ab heavy chain sequence with 5' leader, an IRES, ab light chain sequence with 5' leader and a 3' poly(A) sequence.
SEQ ID NO: 47 DNA sequence corresponding to E2B region of the EnAd genome (bp 10355-5068).
SEQ ID NO: 48 NG-167 virus genome sequence comprising the EnAd genome with a transgene cassette that encodes an anti-VEGF ScFv with a C-terminal His6 tag, inserted in the region $B_Y$. The transgene cassette contains a 5' SSA, anti-VEGF ScFv sequence with 5' leader and a 3' poly(A) sequence.
SEQ ID NO: 49 NG-95 virus genome sequence comprising a transgene cassette that encodes the cytokine, IFNγ, inserted in the region $B_Y$. The transgene cassette contains a 5' CMV promoter, IFNγ cDNA sequence and 3' poly(A) sequence.
SEQ ID NO: 50 NG-97 virus genome sequence comprising a transgene cassette that encodes the cytokine, IFNα, inserted in the region $B_Y$. The transgene cassette contains a 5' CMV promoter, IFNα cDNA sequence and 3' poly(A) sequence.
SEQ ID NO: 51 NG-92 virus genome sequence comprising the EnAd genome with a transgene cassette that encodes the cytokine, IFNγ, inserted in the region $B_Y$. The transgene cassette contains a 5' bSA, IFNγ cDNA sequence and 3' poly(A) sequence.
SEQ ID NO: 52 NG-96 virus genome sequence comprising the EnAd genome with a transgene cassette that encodes the cytokine, IFNα, inserted in the region $B_Y$. The transgene cassette contains a 5' bSA, IFNα cDNA sequence and 3' poly(A) sequence.
SEQ ID NO: 53 NG-139 virus genome sequence comprising the EnAd genome with a transgene cassette that encodes the cytokine, TNFα, inserted in the region $B_Y$. The transgene cassette contains a 5' SSA, TNFα cDNA sequence and 3' poly(A) sequence.
SEQ ID NO: 54 Restriction site insert ($B_Y$).
SEQ ID NO: 55 Restriction site insert ($B_Y$).
SEQ ID NO: 56 NG-220 virus genome sequence comprising the EnAd genome with a transgene cassette that encodes the tumour associated antigen, NY-ESO-1, inserted in the region $B_Y$. The transgene cassette contains a 5' PGK promoter, NY-ESO-1 cDNA sequence and 3' poly(A) sequence.
SEQ ID NO: 57 NG-217 virus genome sequence comprising the EnAd genome with a transgene cassette that encodes the tumour associated antigen, NY-ESO-1, inserted in the region $B_Y$. The transgene cassette contains a 5' CMV promoter, NY-ESO-1 cDNA sequence and 3' poly(A) sequence.
SEQ ID NO: 58 NG-242 virus genome sequence comprising the EnAd genome with a transgene cassette encoding an anti-CTLA-4 full length antibody inserted into the region $B_Y$. The transgene cassette contains a SSA, ab heavy chain sequence with 5' leader, an IRES, ab light chain sequence with 5' leader and a 3' poly(A) sequence.
SEQ ID NO: 59 NG-165 virus genome sequence comprising the EnAd genome with a transgene cassette encoding an anti-VEGF full length antibody inserted into the region $B_Y$. The transgene cassette contains a SSA, ab heavy chain sequence with 5' leader, a P2A peptide sequence, ab light chain sequence with 5' leader and a 3' poly(A) sequence.
SEQ ID NO: 60 NG-190 virus genome sequence comprising the EnAd genome with a transgene cassette encoding an anti-PD-L1 full length antibody inserted into the region $B_Y$. The transgene cassette contains a SSA, ab heavy chain sequence with 5' leader, a P2A peptide sequence, ab light chain sequence with 5' leader and a 3' poly(A) sequence.
SEQ ID NO: 61 NG-221 virus genome sequence comprising the EnAd genome with a transgene cassette that encodes an anti-PD-L1 ScFv with a C-terminal His6 tag, inserted in the region $B_Y$. The transgene cassette contains a 5' SSA, anti-PD-L1 ScFv sequence with 5' leader and 3' 6 × histidine sequence then poly(A) sequence.
SEQ ID NO: 62 NG-258 virus genome sequence comprising the EnAd genome with a transgene cassette encoding an anti-VEGF full length antibody inserted into the region $B_Y$. The transgene cassette contains a CMV promoter, ab heavy chain sequence with 5' leader, a P2A peptide sequence, ab light chain sequence with 5' leader and a 3' poly(A) sequence.
SEQ ID NO: 63 NG-185 virus genome sequence comprising the EnAd genome with unique restriction sites inserted into the $B_X$ and $B_Y$ regions.
SEQ ID NO: 64 pNG-33 (pColoAd2.4) DNA plasmid, comprising a bacterial origin of replication (p15A), an antibiotic resistance gene (KanR) and the EnAd genome sequence with inserted unique restriction sites in the $B_Y$ region.
SEQ ID NO: 65 pNG-185 (pColoAd2.6) DNA plasmid, comprising a bacterial origin of replication (p15A), an antibiotic resistance gene (KanR) and the EnAd genome sequence with inserted unique restriction sites in the $B_X$ and $B_Y$ regions.

SEQ ID NO: 66 NG-sh01 virus genome sequence comprising a transgene cassette encoding an shRNA to GAPDH inserted into the region $B_Y$. The transgene cassette contains a U6 RNA polIII promoter and DNA encoding a shRNA.

SEQ ID NO: 67 Sodium Iodide symporter (NIS) amino acid sequence.

SEQ ID NO: 68 NG-280 virus genome sequence comprising a transgene cassette encoding the sodium iodide symporter (NIS) inserted into the region $B_Y$. The transgene cassette contains a 5' SSA, NIS cDNA sequence and 3' poly(A) sequence.

SEQ ID NO: 69 NG-272 virus genome sequence comprising the EnAd genome with a transgene cassette encoding an anti-VEGF ScFv and an anti-PD-L1 ScFv inserted into the region $B_Y$. The transgene cassette contains a SSA, anti-PD-L1 ScFv sequence with 5' leader and 3' 6×His tag, a P2A peptide sequence, anti-VEGF ScFv sequence with 5' leader and 3' V5-tag and a 3' poly(A) sequence.

SEQ ID NO: 70 anti-CTLA-4 VH chain amino acid sequence.

SEQ ID NO: 71 anti-CTLA-4 VL chain amino acid sequence.

SEQ ID NO: 72 NG-257 virus genome sequence comprising the EnAd genome with a transgene cassette encoding an anti-VEGF ScFv inserted into the region $B_X$. The transgene cassette contains a bSA, anti-VEGF ScFv sequence with 5' leader and 3' 6×His tag then a 3' poly(A) sequence.

SEQ ID NO: 73 NG-281 virus genome sequence comprising the EnAd genome with a transgene cassette encoding an anti-VEGF ScFv inserted into the region $B_X$ and a second transgene cassette encoding an anti-PD-L1 ScFv inserted into the region $B_Y$. The transgene cassette contains a bSA, anti-VEGF ScFv sequence with 5' leader and 3' 6×His tag then a 3' poly(A) sequence.

SEQ ID NO: 74 Restriction site recognised and cut by the enzyme I-CreI.

SEQ ID NO: 75 Restriction site recognised and cut by the enzyme I-CeuI.

SEQ ID NO: 76 Restriction site recognised and cut by the enzyme I-SceI.

SEQ ID NO: 78-90 show primers.

EXAMPLES

"p" employed as a prefix in naming constructs indicates that the construct is a plasmid.

Examples 1-6

Viruses were prepared with sequences shown in SEQ ID NO: 2, 5, 6, 7 & 8, employing the methods described below.

Cell Culture

AD293 cells (Agilent #240085) were cultured in DMEM high glucose with glutamine (Gibco: 10109163), 5 mM L-glutamine, 2 mM Sodium pyruvate, 1 mM non-essential amino acids (PAA:M11-003) and pen/strep. This media is referred to as 'AD293 media'. For routine cell culture media is supplemented with 10% FBS (Gibco: 41965062) and for transfections and infections with 2% FBS. $1.2 \times 10^6$ AD293 cells/flask were seeded into T-25 flasks 24 hours before transfection such that the density at transfection was ~75% confluent.

Virus Genome Transfection

The concentration of plasmid DNA for plasmids, pNG-135, pNG-73, pNG-74, pNG-75 and pNG-76, was measured (Table 2) and 7.0 μg or each was then linearised with the restriction enzyme AscI for 2 hr, 37 degrees. Digested DNA was diluted with 500 nuclease-free water and then purified by phenol/chloroform extraction. The extracted DNA was then precipitated for 16 hrs, −20° C. in 300 μl>95% molecular biology grade ethanol and 10 μl 3M Sodium Acetate. The precipitated DNA was pelleted by centrifuging at 14000 rpm, 5 mins and was washed in 500 μl 70% ethanol, before centrifuging again, 14000 rpm, 5 mins. The clean DNA pellet was air dried, resuspended in 500 μl OptiMEM containing 15 μl lipofectamine transfection reagent and incubated for 30 mins, RT. The transfection mixture was then added drop wise to the T-25 flask containing AD293 cells. After incubation of the cells with the transfection mix for 2 hrs at 37° C., 5% $CO_2$ 4 mls of cell media (DMEM high glucose with glutamine supplemented with 2% FBS) was added to the cells and the flasks was incubated 37° C., 5% $CO_2$. Cells were monitored daily for the presence of cytopathic effect (CPE) (FIG. 1A-E, FIG. 2A-J, FIG. 3A-G). Once substantial CPE was observed the virus was harvested and the harvest time point was recorded in Table 2.

Virus Harvest and Amplification

Cells in media were pipetted from the bottom of the flask and transferred to a 15 ml falcon tube. Cells were pelleted by centrifuging for 5 min, 1500 rpm and the supernatant was collected and stored (~4 ml). The cell pellet was resuspended in 1 ml of AD293 media and virus harvested using three freeze-thaw cycles. For this the cell pellets were frozen in liquid nitrogen then thawed in a 37° C. water bath before centrifugation at 1200 rpm, 10 mins and collection of the supernatant containing the virus. The harvested viruses were used to re-infect AD293 cells in order to amplify the virus stocks. Viable virus production during amplification was confirmed by observation of significant CPE in the cell monolayer (FIG. 1F-G, FIG. 2K-R, FIG. 3H). Once CPE was observed the virus was harvested from 293 cells by three freeze-thaw cycles. Amplification in AD293 cells was repeated up to 5 times until virus stocks that produced significant CPE in cell monolayers within 48 hrs of infection were generated (FIG. 1H-I, FIG. 2S-Z, FIG. 2@ FIG. 3I-M, Table 2).

Virus Purification

Once potent virus stocks were amplified the viruses were purified by double caesium chloride banding to produce NG-135, NG-73, NG-74, NG-76 and NG-78 virus stocks. These stocks were titred by measurement of Abs 260/280 nm (titres are recorded in Table 2).

TABLE 2

| Virus ID | SEQ ID NO: | [plasmid DNA] ng/ml | Significant CPE detected | Amplification Cycles | CsCl Banded virus titre (vp/ml) |
|---|---|---|---|---|---|
| NG-135 | SEQ ID NO: 2 | 241 | 216 hrs | 2 | 1.51e12 |
| NG-73 | SEQ ID NO: 8 | 260 | 192 hrs | 3 | 9.90e10 |
| NG-74 | SEQ ID NO: 5 | 253 | 384 hrs | 5 | 1.09e11 |
| NG-76 | SEQ ID NO: 7 | 330 | 184 hrs | 2 | 9.00e10 |
| NG-78 | SEQ ID NO: 6 | 260 | 312 hrs | 3 | 4.50e11 |

Example 7

VEGF Binding ELISA

The VEGF-binding activity of full length antibody with the amino acid sequence of Bevacizumab secreted from cells infected by EnAd containing a gene SSA-Bev-PA (NG-135) and assessed by enzyme-linked immunosorbent assay (ELISA).

AD293 cells were seeded at a concentration of 3.25e5 cells/ml and allowed to grow for 20 hrs. The cells were infected with either EnAd containing the SSA-Bev-PA transgene cassette or a control virus EnAd containing a SSA-GFP-PA (NG-107) transgene cassette (Control). 44 hrs post-infection supernatants were collected from the infected cells and clarified by centrifuging.

ELISA plates (A Nunc Immuno MaxiSorp 96 well microplate) were prepared by coating overnight at 4° C. with human VEGF-165 (0.5 µg/ml, R and D Systems, 293-VE-050) in carbonate/bicarbonate buffer. Plates were washed between all subsequent binding steps with PBS 0.05% Tween 20. The plates were blocked for 1 hour at room temperature with 3% BSA in PBS 0.05% Tween 20.

Figure 4B:
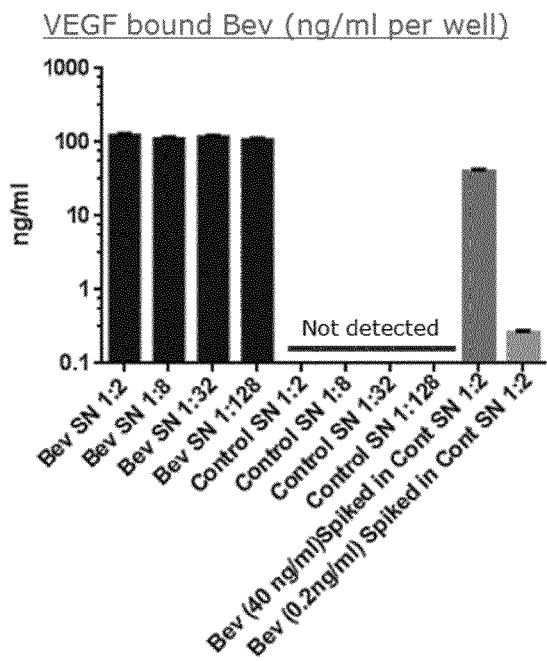

Clarified infection supernatants were diluted into PBS/3% BSA/0.05% Tween 20 (1:2, 1:8, 1:32, 1:128, 1:512, 1:2048). A serial dilution of purified Bevacizumab (1000 ng/ml-0.0128 ng/ml) was prepared and diluted Bevacizumab samples of 40 ng/ml and 0.2 ng/ml were also spiked into the control infection supernatants. All samples were added to the VEGF-165 coated plates and incubated for 1 hr at room temperature. The detection antibody, HRP conjugated anti-human-Fc (Abcam, ab97225) was then applied for 1 hr at room temperature before HRP detection was performed with HRP substrate solution 3.3.5.5'-teramethylethylenediamine (TMB, Thermo-Fisher). 1M HCl was used for stopping the reaction and the developed colour was measured at 450 nm on a plate reader. Absorbance at 450 nm was plotted for the EnAd and Control infection supernatants (FIG. 4A) demonstrating specific binding of secreted anti-VEGF antibody in the supernatant of NG-135 infected cells. The Bevacizumab standard curve was plotted (FIG. 6) and the concentrations of secreted anti-VEGF antibody or spiked Bevacizumab samples bound to VEGF were determined by interpolating from the standard curve (FIG. 4B).

Example 8

Production of EnAd Viruses Encoding Anti-VEGF Antibodies or Anti-VEGF ScFvs

The plasmid pEnAd2.4 (also referred to herein as pCo-loAd2.4 SEQ ID NO: 64), was used to generate the plasmids pNG-135, pNG-73, pNG-74, pNG-76, pNG-78 and pNG-167 by direct insertion of transgene cassettes into the pEnAd2.4 unique restriction sites located between the L5 and E4 genes (region BY). The methods for generating the plasmid are provided in Example 31.

Viruses Prepared pNG-135, contains a transgene cassette encoding an anti-VEGF antibody encoded by inclusion of an anti-VEGF VH chain (SEQ ID NO: 29), an antibody constant heavy chain (SEQ ID NO: 33), an anti-VEGF VL chain (SEQ ID NO: 31) and an antibody constant light chain (SEQ ID NO: 35) in the transgene cassette. pNG-73 and pNG-74 contain transgene cassettes encoding anti-VEGF ScFvs (SEQ ID NO: 36) under the control of either an exogenous promoter, CMV (SEQ ID NO: 13), or the EnAd endogenous major late promoter (MLP). pNG-76, pNG-78 and pNG-167 contain transgene cassettes encoding anti-VEGF ScFvs (SEQ ID NO: 36) with C-terminal Histidine peptide tags (SEQ ID NO.23) under the control of either an exogenous promoter, CMV (SEQ ID NO: 13), or the EnAd endogenous MLP. Schematics of the inserted transgene cassettes in plasmids pNG-135, pNG-73, pNG-74, pNG-76, pNG-78 and pNG-167 are shown in FIG. 24. Construction of plasmids was confirmed by DNA sequencing.

Virus Production

Plasmids pNG-135, pNG-73, pNG-74, pNG-76 and pNG-78 were linearised by restriction digest with the enzyme AscI to produce the virus genomes NG-135 (SEQ ID NO: 2), NG-73 (SEQ ID NO: 8), NG-74 (SEQ ID NO: 5), NG-76 (SEQ ID NO: 7) and NG-78 (SEQ ID NO: 6). The restriction digest reactions were set up according to Table 3 and carried out for 2 hrs, 37° C.:

TABLE 3

| Reagent | Volume (µl) | Supplier |
|---|---|---|
| plasmid DNA (~7 µg) | ~15 | |
| AscI | 2.5 | NEB R0558S |
| Buffer 4 | 5 | NEB B7004S |
| Nuclease free water | 27.5 | Fisher Scientific (BPE 2484-100) |

Digested DNA was diluted with 50 µl nuclease-free water and then purified by phenol/chloroform extraction. The extracted DNA was then precipitated for 16 hrs, −20° C. in 300 µl>95% molecular biology grade ethanol and 10 µl 3M Sodium Acetate. The precipitated DNA was pelleted by centrifuging at 14000 rpm, 5 mins and was washed in 500 µl 70% ethanol, before centrifuging again, 14000 rpm, 5 mins. The clean DNA pellet was air dried, resuspended in 500 µl OptiMEM containing 15 µl lipofectamine transfection reagent and incubated for 30 mins, RT. The transfection mixture was then added drop wise to a T-25 flask containing HEK293 cells grown to 70% confluency. After incubation of the cells with the transfection mix for 2 hrs at 37° C., 5% $CO_2$ 4 mls of cell media (DMEM high glucose with glutamine supplemented with 2% FBS) was added to the cells and the flasks was incubated 37° C., 5% $CO_2$.

The transfected HEK293 cells were monitored every 24 hrs and were supplemented with additional media every 48-72 hrs. The production of virus was monitored by observation of a significant cytopathic effect (CPE) in the cell monolayer (FIG. 1A-E, FIG. 2A-J and FIG. 3A-G). Once extensive CPE was observed the virus was harvested from 293 cells by three freeze-thaw cycles. The harvested viruses were used to re-infect 293 cells in order to amplify the virus stocks. Viable virus production during amplification was confirmed by observation of significant CPE in the cell monolayer (FIG. 1F-G, FIG. 2K-RH, FIG. 3H). Once CPE was observed the virus was harvested from 293 cells by three freeze-thaw cycles. Amplification in 293 cells was repeated up to 5 times until virus stocks that produced significant CPE in cell monolayers within 48 hrs of infection were generated (FIG. 1H-I, FIG. 2S-Z, FIG. 2 @, FIG. 3I-M). Once potent virus stocks were amplified the viruses were purified by double caesium chloride banding to produce NG-135, NG-73, NG-74, NG-76 and NG-78 virus stocks.

Example 9

Characterisation of NG-135 Virus Activity Compared to EnAd in Colon Carcinoma Cell Lines NG-135 or EnAd virus replication (assessed by qPCR), gene expression (assessed by RTqPCR) and anti-VEGF antibody expression (assessed by VEGF binding ELISA was compared in colon carcinoma cell lines. NG-135 (SEQ ID NO: 2) is a virus derived from EnAd that contains an anti-VEGF antibody transgene cassette after the EnAd late gene, L5 (Fibre). A schematic of the inserted cassette is shown in FIG. 10A and FIG. 24. Production of NG-135 virus is detailed in Example 8. HCT-116, DLD or HT-29 colon carcinoma cell lines were seeded in 6 well plates at cell densities of 7.5e5 cells/well for HCT-116 and DLD cells or 2.e6 cells/well for HT-29 cells. Plates were incubated for 18 hrs, 37° C., 5% $CO_2$, before cells were either infected with, 100 or 10 EnAd or NG-135 virus particles per cell (ppc) or were left uninfected. Assays were carried out 24, 48 or 72 hrs post infection.

Quantification of Viral DNA by qPCR

HT-29 and DLD cells lines either infected for 72 hrs with 10 ppc EnAd or NG-135 or left uninfected were used for quantification of viral DNA by qPCR. Cell supernatants were collected and clarified by centrifuging for 5 mins, 1200 rpm. The cells were washed once with PBS and lysed by freeze-thaw at −20° C. in 400 µl/well 1× reporter lysis buffer (Promega: E3971). DNA was extracted from 3 µl of cell lysate or 10 µl of supernatant using the Sigma Genelute DNA extraction Kit, according to the manufacturer's protocol. A standard curve using EnAd virus particles (2.5e10-2.5e5vp) was also prepared and extracted using the Sigma Genelute Kit. Each extracted sample or standard was analysed by qPCR using an EnAd E3 gene specific primer-probe set in the reaction mix detailed in Table 4

TABLE 4

| Reagent | Volume/well (µl) |
|---|---|
| Taqman fast advance master mix (Lifetech) | 5 |
| EnAd Forward primer | 0.08 |
| EnAd Reverse primer | 0.08 |
| EnAd Probe | 0.02 |
| NFW | 2.82 |
| Sample | 2 |
| Well Volume | 10 | qPCR was carried out according to the programme in Table 5:

TABLE 5

| No. Cycles | Temperature (° C.) | Duration (secs) |
|---|---|---|
| 1 | 50 | 120 |
| 1 | 95 | 20 |
| 40 | 95 | 1 |
|  | 60 | 20 |

Quantification of the number of detected virus genomes per cell demonstrated that NG-135 or EnAd virus replication was comparable in both HT-29 and DLD cell lines (FIG. 11A). No virus genomes could be detected in uninfected cells (data not shown).

Analysis of Viral (Hexon) or Anti-VEGF Antibody Gene Expression by RTqPCR

HT-29 and DLD cells lines either infected for 72 hrs with 10 ppc EnAd or NG-135 or left uninfected were used for analysis of hexon or anti-VEGF antibody gene expression by RTqPCR. Supernatant was removed from each well and the cells were washed with PBS and then lysed in 600 µl/well RLT buffer (QIAgen) containing (3-mercaptoethanol (1:100). Cell lysates were clarified by centrifuging for 3 mins, 13000 rpm and 200 µl of the lysate was then used for extraction of RNA using the Allprep DNA/RNA/protein extraction kit (QIAgen) according to the manufacturer's protocol. The concentration of RNA extracted from each sample was measured and 800 ng was used for cDNA synthesis using SuperScript III First Strand Synthesis Super-Mix for qRT-PCR (Life Technologies; 11752-050) according to the manufacturer's protocol. 1 µl of each synthesised DNA sample was used for analysis by qPCR using either a EnAd hexon-specific primer-probe set or anti-VEGF antibody specific primer-probe set in the reaction mix detailed below, Table 6

TABLE 6

| Reagent | Volume/well (µl) |
|---|---|
| Taqman fast advance master mix (Lifetech) | 5 |
| Forward primer | 0.08 |
| Reverse primer | 0.08 |
| Probe | 0.02 |
| NFW | 3.82 |
| Sample | 1 |
| Well Volume | 10 | qPCR was carried out according to the programme in Table 5. Quantification of the number of DNA copies detected by qPCR demonstrated comparable expression of the virus late gene, Hexon, in NG-135 or EnAd infected HT-29 or DLD cells (FIG. 11B). However, anti-VEGF antibody gene expression was only detected in HT-29 or DLD cells infected with the NG-135 virus that contains the anti-VEGF antibody transgene cassette (FIG. 12).

Analysis of Anti-VEGF Antibody Expression by VEGF Binding ELISA

HT-29, DLD and HCT-116 cells lines either infected for 24, 48 or 72 hrs with 100 ppc EnAd or NG-135 or left uninfected were used for analysis of antibody expression by VEGF binding ELISA.

Culture supernatants were removed from each well and centrifuged for 5 mins, 1200 rpm to remove cell debris. ELISA plates (Nunc Immuno MaxiSorp 96 well microplate) were coated with human VEGF-165 (0.5 µg/ml, R and D Systems, 293-VE-050) and blocked according to the methods detailed in Example 7. Infection supernatants were diluted into PBS/3% BSA/0.05% Tween 20 (1:2 or 1:4) and a serial dilution of purified anti-VEGF antibody (1000 ng/ml-0.0128 ng/ml) was prepared. All samples were added to the VEGF-165 coated plates and assayed according to the methods detailed in Example 7.

The concentrations of secreted anti-VEGF antibody bound to VEGF were determined by interpolating from the standard curves. Anti-VEGF antibody expression increased over time in HT-29, DLD and HCT cells up to 72 hrs, at which point comparable antibody expression was detected in the supernatant of all cell lines assayed (FIG. 13).

Example 10

Quantification of Anti-VEGF Antibody Expression in Colon Carcinoma and Lung Carcinoma Cell Lines HT-29 colon carcinoma and A549 lung carcinoma cell lines were plated in 12 well plates at densities of 1e6 cells/well for HT-29 and 5e5 cells/well for A549 cells. Plates were incubated for 24 hrs, 37° C., 5% $CO_2$, before cells were infected with, 100 EnAd or NG-135 virus particles per cell (ppc) or were left uninfected. Assays were carried out 24, 48 or 72 hrs post infection.

At each time point culture supernatants were removed from each well and replaced with 400 µl of cell culture media. Plates were then incubated for 5 mins, 1 hr or 3 hrs before the media was collected from each well and centrifuged for 5 mins, 1200 rpm to remove cell debris. ELISA plates (Nunc Immuno MaxiSorp 96 well microplate) were coated for 16 hrs, 4° C., with mouse monoclonal anti-human IgG1 Fc antibody (2 µg/ml, ab1927, Abcam) diluted in carbonate/bicarbonate buffer. The plates were blocked for 1 hour at room temperature with 3% BSA in PBS 0.05% Tween 20 before being washed with PBS 0.05% Tween 20. Plates were washed 3 times with PBS 0.05% Tween 20 between all subsequent binding steps.

Clarified infection supernatants were diluted into 3% BSA/PBS 0.05% Tween 20 (1:2, 1:8, 1:32). A serial dilution of purified Bevacizumab (200 ng/ml-0.1 ng/ml) was also prepared in PBS/3% BSA/0.05% Tween 20. Samples and standards were added to the coated plates and incubated for 1 hr at room temperature. The detection antibody, HRP conjugated anti-human-IgG-Fab (0.5 µg/ml Abcam ab87422) was then applied for 1 hr at room temperature before HRP detection was performed with HRP substrate solution 3.3.5.5'-teramethylethylenediamine (TMB, Thermo-Fisher). 1M HCl was used for stopping the reaction and the developed colour was measured at 450 nm on a plate reader. The concentrations of secreted anti-VEGF antibody in HT-29 cells (FIG. 28A) and A549 cells (FIG. 28B) were determined by interpolating from the standard curves. The total protein that would be predicted to be expressed by 1e6 HT-29 or A549 cells over 24, 48 and 72 hrs is summarised in FIG. 28C.

Example 11

Expression of Anti-VEGF ScFv in a Colon Carcinoma Cell Line

NG-76 (SEQ ID NO: 7), NG-78 (SEQ ID NO: 6) and EnAd anti-VEGF ScFv expression was compared in HT29 colon carcinoma cells by western blot. NG-76 and NG-78 are viruses derived from EnAd that contain anti-VEGF ScFv transgene cassettes after the EnAd late gene, L5 (Fibre). Schematics of the inserted cassettes are shown in FIGS. 10B and C and production of the viruses is described in Example 8.

HT-29 cells were seeded in 6 well culture plates at a density of 4e6 cells/well and were incubated for 5 hrs at 37° C., 5% $CO_2$. The cells were then infected for 22, 46 or 70 hrs with 50 NG-76, NG-78 or EnAd virus particles per cell. Media was removed from the wells and the cells were washed once with PBS before lysis in 2500 lysis buffer (150 mM NaCl, 1% Triton X-100, 0.5% SDS, 50mM Tris-HCl (pH7.5)) containing anti-protease inhibitor cocktail III (Calbiochem: 539134). The lysates were treated with benzonase to degrade genomic DNA and were further diluted 1:4 in lysis buffer containing NuPAGE LDS sample buffer and NuPAGE reducing agent (Life Technologies). The samples were heated for 10 mins, 70° C. before carrying out SDS-PAGE using 4-12% Bis-Tris NuPAGE gels (Life Technologies) according to the manufacturer's protocol. Proteins were transferred onto PVDF membranes by western blot using the XceII II Blot Module (Life Technologies). Blocking and immunoblotting was carried out in PBS 0.1% Tween-20 supplemented with 5% milk powder and all wash steps were carried out in PBS 0.1% Tween-20. Anti-VEGF ScFvs were detected using mouse monoclonal anti-Ct-Hisx6 antibody to the His-tag at the C-terminus of the ScFv and secondary antibody detection was carried out using Rabbit anti-mouse IgG-HRP. Proteins were visualised by enhanced chemiluminescence. ScFv expression could be detected in HT-29 cell lysates infected with NG-76 or NG-78 but not in cells infected with EnAd (labelled as 76, 78 and Ad1, respectively in FIG. 14A). ScFv expression was detectable earlier, by 22 hrs, in cells infected with the NG-76 virus in which the ScFv expression is under the control of an exogenous promoter compared to the NG-78 virus in which the ScFv expression is under the control of the endogenous major late promoter.

Example 12

Anti-VEGF ScFv Expression Detected by VEGF Binding ELISA

NG-76 (SEQ ID NO: 7) and EnAd, anti-VEGF ScFv expression was compared in human embryonic kidney cell lines by VEGF binding ELISA or Western blot. AD293 cells were seeded in 6 well culture plates at a density of 5e5 cells per well. 24 hrs post-seeding AD293 cells were infected with NG-76 or EnAd at 100 virus particles per cell. Cells were cultured for 72 hrs before the supernatants were collected from the wells and centrifuged for 5 mins, 1200 rpm to remove cell debris. The clarified supernatants were then used for either VEGF binding ELISA or Western blot analysis. For ELISA supernatants were diluted 1:2 in 3% BSA/PBS 0.05% Tween and then had either 8 ng/ml anti-VEGF antibody spiked into them or were left without antibody. ELISA plates were coated with VEGF and blocked according to the method detailed in Example 7. Samples were added to the plates at 100 µl/well and assay. The detection antibody, HRP conjugated polyclonal anti-His (Abcam ab1187) was then applied for 1 hr at room temperature before HRP detection was performed with HRP substrate solution 3.3.5.5'-teramethylethylenediamine (TMB, Thermo-Fisher). 1M HCl was used for stopping the reaction and the developed colour was measured at 450 nm on a plate reader. Absorbance at 450 nm was plotted for the EnAd, NG-76 and NG-76+8 ng/ml anti-VEGF antibody infection supernatants (FIG. 14B). Specificity of the expressed ScFv for VEGF in the supernatants of NG-76 infected cells was confirmed by the partial inhibition of VEGF binding by addition of 8 ng/ml of purified human anti-VEGF antibody, bevacizumab. For Western blot supernatants were prepared and assayed according to methods detailed in Example 11. ScFv expression could be detected at low levels 24 hrs post infection and expression had significantly increased by 44 hrs (FIG. 7).

Example 13

Characterisation of NG-135 Virus Activity Compared to EnAd in Tumour Bearing Mice DLD or HCT-116 colon carcinoma cells were implanted as a subcutaneous xenograft in CD1 nu/nu mice. Once tumours reached ~100 mm$^3$ mice were grouped and treated with 5e9 EnAd or NG-135 virus particles delivered by single intra-tumoural injection. In each study a group of uninfected control mice was also included. DLD tumours were resected day 3, 7 or 28 post-treatment and HCT-116 tumours were resected day 3, 7 or 14 post-treatment.

Analysis of Virus Genome Replication by qPCR

Resected tumours were weighed and homogenised in 1× reporter lysis buffer (Promega E3971) containing 1:200 anti-protease inhibitor cocktail III (Calbiochem) at a concentration of 100 µl buffer per 25 mg of tumour. The untreated tumour homogenates were used to prepare an EnAd virus standard curve (2.5e10-2.5e5 vp/tumour lysate sample). DNA was extracted from 2 µl of each treated tumour sample or from 100 µl of each standard using the Sigma Genelute DNA extraction kit, according to the manufacturer's protocol. Extracted samples and standards were analysed by qPCR using an EnAd E3 gene specific primer-probe set according to the qPCR methods detailed in Example 8. Quantification of the number of virus genomes per tumour is shown for DLD tumours Day 3 or Day 7 post-treatment (FIG. 15A) or Day 28 post-treatment (FIG. 15B). Quantification of the number of virus genomes per tumour is shown for HCT tumours Day 3, Day 7 or Day 14 post-treatment with EnAd or NG-135 (FIG. 18A). Collectively the data show no significant difference between EnAd and NG-135 virus replication in HCT or DLD tumours.

Analysis of Viral (Hexon) or Anti-VEGF Antibody Gene Expression by RTqPCR

Resected tumours were weighed and homogenised in RLT lysis buffer (QIAgen) containing β-mercaptoethanol (Sigma) at a concentration of 350 µl of buffer per 20 mg of tumour. RNA was extracted from the tumour samples using the AllPrep DNA/RNA/Protein Mini kit (QIAgen) and treated with the RNAse free DNAse set (QIAgen) according to the manufacturer's protocols. The concentration of RNA extracted from each sample was measured and 800 ng was used for cDNA synthesis and qPCR according to the RTqPCR methods detailed in Example 8. Quantification of the number of RNA copies detected by qPCR demonstrated comparable expression of the virus late gene, hexon, in NG-135 or EnAd treated DLD tumours Day 3 or Day 7 post-treatment (FIG. 16A). In contrast, anti-VEGF antibody gene expression (RNA) was only detected in DLD cells treated with the NG-135 virus (FIG. 16B).

Anti-VEGF Antibody Expression Detected by Anti-Human IgG1 or VEGF Binding ELISA

Resected tumour lysates prepared for qPCR (above) were also used for analysis of anti-VEGF antibody expression by anti-human IgG1 ELISA (Abcam Kit) or VEGF binding ELISA. Serum from blood samples taken at the point of tumour resection were also assayed for human IgG1 by ELISA.

Prior to assaying tumour lysates from treated and control mice were diluted 1:2 in 150 µl 1× reporter or lysis buffer (Promega) containing 2% Triton X-100, briefly vortexed and sonicated for 5 mins in a sonicating water bath. Blood samples were centrifuged for 5 mins, 5000 rpm and the serum collected. A serial dilution of purified anti-VEGF antibody, bevacizumab (1000 ng/ml-0.0128 ng/ml) was prepared and spiked into either pooled control mice lysates or serum samples from untreated mice to produce the assay standard curves.

Human IgG1 ELISA (Abcam)

Sonicated lysates from NG-135 or EnAd treated tumours were further diluted 1:2 into assay buffer and as a positive control an EnAd-treated mouse tumour lysate sample was spiked with 8 ng/ml purified bevacizumab. Serum samples were diluted 1:2 or 1:5 into assay buffer. All samples and standards were then assayed for anti-human IgG1 using the Abcam ELISA Kit according to the manufacturer's protocol. The concentrations of antibody in the tumours were determined by interpolating from the standard curves. Human IgG1 antibody expression could be detected in DLD tumours treated with NG-135 and assayed 28 days post treatment (FIG. 17A) and in a serum sample from a NG-135 treated mouse assayed 28 days post treatment (FIG. 19). Antibody was also detected in all HCT-116 tumours treated with NG-135 and assayed 3, 7 or 14 days post-treatment (FIG. 18B). Antibody expression could not be detected in any tumours or blood samples from mice treated with EnAd.

VEGF Binding ELISA

Sonicated lysates from NG-135 or EnAd treated tumours were further diluted 1:2 into assay buffer and as a positive control a EnAd treated mouse tumour lysate sample was spiked with 1.6 ng/ml purified bevacizumab. ELISA plates (Nunc Immuno MaxiSorp 96 well microplate) were coated with human VEGF-165 (0.5 µg/ml) according to the methods detailed in Example 7. Samples and standards supernatants were added to the VEGF-165 coated plates and assayed according to the methods detailed in Example 7. The concentrations of anti-VEGF binding antibody in the tumours were determined by interpolating from the standard curve. Anti-VEGF antibody able to bind hVEGF-165 was detectable in NG-135 treated DLD tumour samples but not EnAd treated samples (FIG. 17B).

Example 14

Production and Characterisation of EnAd Viruses Encoding Reporter Genes

A panel of GFP or luciferase expressing reporter viruses were produced in which transgene expression was under the control of an exogenous viral promoter, CMV (NG-47, NG-61, an exogenous mammalian promoter, PGK (NG-159), the endogenous virus major late promoter (NG-62, NG-63, NG-93, NG-98, NG-105, NG-106, NG-107, NG-108) or the endogenous virus early promoter, E4 (NG-109, NG-110). All viruses were derived from EnAd using the cloning plasmid pEnAd2.4 (described in application number GB1322851.5) and have transgene cassettes inserted after the EnAd late gene, L5 (Fibre).

Virus Production

The plasmid pEnAd2.4 was used to generate the plasmids pNG-47, pNG-62, pNG-93, pNG-105, pNG-106, pNG-107, pNG-108, pNG-109, pNG-110 and pNG-159 by direct insertion of transgene cassettes encoding green fluorescent protein (GFP, SEQ ID NO: 38) into the pEnAd2.4 unique restriction sites located between the L5 and E4 genes. Schematics of the inserted transgene cassettes in plasmids pNG-47, pNG-62, pNG-93, pNG-105, pNG-106, pNG-107, pNG-108, pNG-109, pNG-110 and pNG-159 are shown in FIG. 22. Plasmid pEnAd2.4 (SEQ ID NO: 64) was also used to generate plasmids pNG-61 and pNG-63 by direct insertion of transgene cassettes encoding the luminescent protein, luciferase (SEQ ID NO: 39), into the pEnAd2.4 unique restriction sites. Schematics of the inserted transgene cassettes in plasmids pNG-61 and pNG-63 are shown in FIG. 22. All plasmids were confirmed by DNA sequencing. The plasmids encoding reporter genes were linearised and transfected into HEK293 cells to produce virus particles according to the 'virus production' methods detailed in Example 8. The amplified virus particles were purified by double caesium chloride banding to produce virus stocks; NG-47, NG-62, NG-93, NG-105, NG-106, NG-107, NG-108, NG-109, NG-110, NG-61 and NG-63.

Virus Characterisation

NG-47, NG-62, NG-93, NG-105, NG-106, NG-107, NG-108, NG-109, NG-110 or EnAd virus replication (assessed by qPCR) and GFP gene expression (assessed fluorescence assay) was compared in colon carcinoma cell line, HT-29. HT-29 colon carcinoma cell lines were seeded in 12 well plates at cell densities of 1e6 cells/well. Plates were incubated for 24 hrs, 37° C., 5% $CO_2$, before cells were either infected with 1 virus particles per cell (ppc) of each of the viruses detailed above or were left uninfected. Assays were carried out 24, 48, 72 or 96 hrs post infection.

Quantification of Viral DNA by qPCR

Cell supernatants were collected and clarified by centrifuging for 5 mins, 1200 rpm. The cells were washed once with PBS and lysed by freeze-thaw at −20° C. in 400 µl/well 1× reporter lysis buffer (Promega: E3971). DNA was extracted from 1 µl of cell lysate or 10 µl of supernatant using the Sigma Genelute DNA extraction Kit, according to the manufacturer's protocol. A standard curve using EnAd virus particles (2.5e10-2.5e5vp) was also prepared and extracted using the Sigma Genelute Kit. Each extracted sample or standard was analysed by qPCR using a EnAd E3 gene specific primer-probe set according to the qPCR methods detailed in example 9. Quantification of the number of virus genomes per cell is shown 24, 48, 72 or 96 hrs post infection (FIG. 27A).

Quantification of Transgene Expression by Fluorescence

Cell lysates prepared above were assayed using either 25 µl of thawed neat lysated or lysate diluted 1:2 1× reporter lysis buffer (Promega: E971). The level of GFP fluorescence in each well was measured on a plate reader (BioTek Synergy HT). The measured, background subtracted, fluorescence for samples infected for 24, 48, 72 or 96 hrs is plotted in FIG. 27B.

Example 15

Characterisation of EnAd Viruses Encoding Reporter Genes Under the Control of the Exogenous Promoter, CMV Virus replication (assessed by qPCR), oncolytic activity (assessed by cell viability assay) and reporter gene expression (assessed by fluorescence) for reporter viruses NG-47 and NG-61 was compared to EnAd. Production and design of viruses NG-47 and NG-61 is detailed in Example 14.

Characterisation of Virus Replication and Transgene Expression

HT-29 colon carcinoma cells, W138 fibroblast cell line or MRC5 fibroblast cell line were seeded in 6 well plates at a cell density 2.e6 cells/well. Plates were incubated for 18 hrs, 37° C., 5% $CO_2$, before cells were either infected with 1 EnAd, NG-47 or NG-61 virus particles per cell (ppc). Assays were carried out 24, 48, 72 or 96 hrs post infection. Cell supernatants were collected and clarified by centrifuging for 5 mins, 1200 rpm. The cells were washed once with PBS and lysed by freeze-thaw at −20° C. in 400 µl/well 1× reporter lysis buffer (Promega: E3971). DNA was extracted from cell lysate or supernatant using the Sigma Genelute DNA extraction Kit, according to the manufacturer's protocol. A standard curve using EnAd virus particles (2.5e10-2.5e5vp) was also prepared and extracted using the Sigma Genelute Kit. Each extracted sample or standard was analysed by qPCR using a EnAd E3 gene specific primer-probe. Quantification of the number of detected virus genomes per cell demonstrated that NG-47 and NG-61 replication was comparable to EnAd (labelled as EnAd in FIGS. 25 & 26) in HT29 cells (FIGS. 25A and 25B) and in HT29, W138 and MRC5 cell lines (FIG. 26C). NG-47 and EnAd cell lysates prepared above were also used to assess transgene expression. Relative GFP fluorescence was measured on a plate reader (BioTek) on either neat lysate or lysate diluted 1:2 in 1× reporter lysis buffer (FIG. 25C).

Comparison of Virus Oncolytic Potency

HT-29 colon carcinoma cells were seeded in 96 well plates at a cell density of 2.5e4 cells/well. Plates were incubated for 4 hrs, 37° C., 5% $CO_2$, before cells were either infected with EnAd, NG-47 or NG-61 virus particles at an infection density range of 100-0.39 particles per cell (ppc). HT-29 cell viability was assessed using Cell Titre 96 MTS Reagent (Promega: G3581) 72 hrs post infection. Quantification of the % cell survival at each infection density demonstrated that NG-47 and NG-61 oncolytic potency was comparable to EnAd in HT29 cells (FIGS. 26A and 26B).

Example 16

Production of EnAd Viruses Encoding Antibodies to Immune-Checkpoint Inhibitor Pathway Proteins The plasmid pEnAd2.4 (SEQ ID NO: 64) was used to generate the plasmid pNG-177, by direct insertion of a transgene cassette encoding an anti-human PD-L1 antibody (YW243.55.570) between the pEnAd2.4 unique restriction sites located between the L5 and E4 genes. The pNG-177 plasmid encodes an anti-PD-L1 VH chain (SEQ ID NO: 30), an antibody constant heavy chain (SEQ ID NO: 34), an anti-VEGF VL chain (SEQ ID NO: 32) and an antibody constant light chain (SEQ ID NO: 35). A Schematic of the inserted anti-PD-L1 antibody cassette present in the NG-177 virus genome (SEQ ID NO: 46) is shown in FIG. 24.

Example 17

Production and Characterisation of EnAd Viruses Encoding Cytokines

Virus Production

The plasmid pEnAd2.4 was used to generate the plasmids pNG-92, pNG-95, pNG-96, pNG-97, pNG-139 and pNG-136 by direct insertion of transgene cassettes encoding human Interferon-γ (IFNγ (SEQ ID NO: 41; pNG-92 and pNG-95),human Interferon-α (IFNα SEQ ID NO: 42; pNG-96 and pNG97) or human Tumour necrosis factor alpha (hTNFα SEQ ID NO: 40; pNG-139) into the pEnAd2.4 unique restriction sites located between the L5 and E4 genes (region $B_y$). Schematics of the inserted transgene cassettes in plasmids pNG-92, pNG-95, pNG-96, pNG-97 and pNG-139 are shown in FIG. 23. Construction of plasmids was confirmed by DNA sequencing.

The plasmids pNG-92, pNG-95 and pNG-139 were linearised to produce the NG-92 (SEQ ID NO: 51) NG-95 (SEQ ID NO: 49) and NG-139 (SEQ ID NO: 53) genomes. Genomes were transfected into HEK293 cells to produce virus particles according to the 'virus production' methods detailed in Example 8. The amplified virus particles were purified by double caesium chloride banding to produce NG-92, NG-95 and NG-139 virus stocks. The production of viable NG-139 virus particles during amplification was confirmed by immunostaining for the EnAd capsid protein, Hexon. HT-29 cells were infected with virus lysate for 48 hrs, the media was then removed from the cells, the cells were fixed in 1:1 MeOH:Acetone and stained with anti-adenovirus antibody (Abcam: ab7428) for 1 hr at RT. The cells were then washed and secondary antibody detection carried out using HRP conjugated anti-mouse IgG (Abcam: ab6728). Hexon protein was visualised by addition of DAB substrate for 25 mins. Hexon staining could be detected throughout the cell monolayers (FIG. 29A and FIG. 29B).

Quantification of TNFα Production in Colon Carcinoma Cell Lines and a Colon Carcinoma Subcutaneous Xenograft Tumour Model HT-29 colon carcinoma cell lines were plated in 6 well plates at a density of 5e5 cells/well. Cells were infected with 100 NG-139 virus particles per cell (ppc) or were left uninfected. Assays were carried out 24 or 36 hrs post infection.

At each time point culture supernatants were removed from each well and centrifuged for 5 mins, 1200 rpm to remove cell debris. Clarified supernatants were diluted into assay buffer and used in TNFα ELISA according to the manufacturer's protocol. The concentrations of secreted TNFα were determined by interpolating from the standard curves and are shown in FIG. 29C.

DLD colon carcinoma cells were implanted as a subcutaneous xenograft in CD1 nu/nu mice. Once tumours reached ~100 mm$^3$ mice were grouped and treated with 5e9 EnAd or NG-139 virus particles delivered by single intratumoural injection on days 0, 3 and 6. In each study a group of uninfected control mice was also included. DLD tumours were resected day 15 post-treatment and assay for TNFα production by ELISA according to the manufacturer's protocol. The concentrations of TNFα detected in the tumour were determined by interpolating from the standard curve and are shown in FIG. 29D.

Example 18

Virus Replication and Anti-VEGF Antibody Expression in Colon, Ovarian and Lung Carcinoma Cell Lines NG-135 (SEQ ID NO: 2) and EnAd, virus replication and anti-VEGF antibody expression was compared in colon (HT-29, HCT116, DLD), lung (A549) or ovarian (SKOV3) carcinoma cell lines by hIgG1 ELISA. Cells were seeded in 12 well culture plates at a density of 5e5-1e6 cells per well. 24 hrs post-seeding cell lines were infected with NG-135 or EnAd at 100 virus particles per cell. Cells were cultured for 24, 48, 72, 96 or 120 hrs before the supernatants were collected from the wells and centrifuged for 5 mins, 1200 rpm to remove cell debris. Half the supernatant was used to assess antibody production and the other half was used to assess virus genomes. The cells in each well were then washed with 1xPBS and lysed in 1x reporter lysis buffer (Promega). The lysates were freeze thawed and then assessed for virus replication.

DNA was extracted from 1-5 µl of cell lysate or 10 µl of supernatant using the Sigma Genelute DNA extraction Kit, according to the manufacturer's protocol. A standard curve using EnAd virus particles (2.5e10-2.5e5vp) was also prepared and extracted using the Sigma Genelute Kit. Each extracted sample or standard was analysed by qPCR using an EnAd E3 gene specific primer-probe set according to the methods detailed in example 9. The maximum replication across all time points in each cell line is plotted for EnAd and NG-135 in FIG. 33A.

ELISA plates (Nunc Immuno MaxiSorp 96 well microplate) were prepared by coating overnight at 4° C. with mouse monoclonal anti-human IgG1 Fc antibody (ab1927 Abcam) in carbonate/bicarbonate buffer. Plates were washed between all subsequent binding steps with PBS 0.05% Tween 20. The plates were blocked for 1 hour at room temperature with 3% BSA in PBS 0.05% Tween 20.

Clarified infection supernatants were diluted in 3% BSA in PBS 0.05% Tween 20 (1:2, 1:4, 1:16). A serial dilution of purified Bevacizumab (1000 ng/ml-0.0128 ng/ml) was prepared and diluted. Bevacizumab samples of 8 ng/ml were also spiked into the control infection supernatants. All samples were added to the coated plates and incubated for 1 hr at room temperature. The detection antibody, HRP conjugated anti-human-Fab was then applied for 1 hr at room temperature before HRP detection was performed with HRP substrate solution 3.3.5.5'-teramethylethylenediamine (TMB, Thermo-Fisher). 1M HCl was used for stopping the reaction and the developed colour was measured at 450 nm on a plate reader. The concentrations of secreted anti-VEGF antibody were determined by interpolating from the Bevacizumab standard curve (FIG. 33B).

Example 19

Characterisation of Antibody Production from NG-135 Treated Tumours

HCT-116 colon carcinoma cells were implanted as a subcutaneous xenograft in CD1nu/nu mice. Once tumours reached ~100 mm$^3$ mice were grouped and treated with 5e9 EnAd or NG-135 virus particles delivered by single intratumoural injection. 10 days post treatment the tumours from some animals were resected, weighed and cut into ~100 mg sections. Each section was placed into a filter cup (Nunc) in a 12 well plate and then ex vivo cultured for 7 days in DMEM media supplemented with 10% FBS. The tumour sections and the ex vivo culture media was assayed for viral genome replication or antibody expression at days 0 or 7 post-resection. Sera were taken from other animals for measurements of circulating anti-VEGF antibody Analysis of Virus Genome Replication by qPCR Culture media was removed from the filter cups and the surrounding well. For qPCR, media samples were diluted 1:200 in Sigma Genelute DNA extraction kit resuspension buffer and resected tumours or cultured tumour sections were homogenised in 1x reporter lysis buffer (Promega E3971) containing 1:200 anti-protease inhibitor cocktail at a concentration of 100 µl buffer per 25 mg of tumour. EnAd standards were prepared and DNA extraction and qPCR was carried out according to methods detailed in example 13. Quantification of the number of virus genomes per tumour at Day 0 or Day 7 post-resection demonstrated an increase in total viral genomes at day 7 for both EnAd and NG-135 suggesting continued viral genome production during ex vivo culture. Data for NG-135 is shown in FIG. 35A.

Analysis of Anti-VEGF Antibody Expression by Anti-Human IgG1

Homogenised tumour samples or neat media samples prepared for qPCR, were used for analysis of antibody expression by anti-human IgG1 ELISA. Samples were diluted 1:2 into 3% BSA/PBS 0.05% Tween and then IgG1 ELISA was carried out according to the methods detailed in Example 18. Antibody could be detected in HCT-116 tumours at the point of resection (day 0) but the amount of detectable antibody produced by the tumours had significantly increased following 7 days of ex vivo culture (FIG. 35B). Sera from mice taken at day 7 or 14 post IT injection with NG-135, tested by anti-human IgG1 ELISA, showed detectable levels of antibody at day 14 (FIG. 35C). No antibody could be detected in sera or ex vivo culture samples from mice that had been treated with EnAd.

Example 20

Characterisation of NG-135 Virus Activity in a Murine Orthotopic Xenograft Model of Lung Cancer A549 lung carcinoma cells were injected intravenously into CB17 SCID mice and tumours allowed to develop in the lungs. 8 weeks post injection mice were grouped and treated with either, 5e9 EnAd or NG-135 virus particles delivered by intravenous administration, or were left untreated via injection of only PBS. Lungs and livers were harvested from the mice day 3, 11, 18 or 25 post-treatment (FIG. 36A). At each time point any visible tumour nodules in the lung were resected and both the pooled nodules from each lung and the remaining lung tissues were rapidly frozen in liquid nitrogen. The lung tissue and lung tumour nodules were assessed for A549 tumour burden and virus genomes by qPCR.

Analysis of Virus Genome Replication or A549 Cell Burden by qPCR

Resected lung tissue, tumour nodules or liver tissues were homogenised in 1× reporter lysis buffer. DNA was extracted from 10-100 µl of the homogenised samples using the Sigma Genelute DNA extraction kit according the manufacturer's protocol. To assess virus genome replication, samples and standard curves were prepared and analysed according to methods detailed in example 13. To assess A549 cell burden a standard curve was prepared by spiking A549 cells (2.25e6-3.6e3 cells) into untreated homongenised lung tissue and then extracting total DNA using the Sigma Genelute DNA extraction kit. The extracted standards and samples were analysed for A549 cell burden by qPCR using a human prostaglandin E receptor (PTGER2) gene specific primer-probe set and the reaction mix and program used for EnAd qPCR as detailed in Example 9. Quantification of A549 tumour burden at day 3 post-treatment showed a similar A549 tumour burden in NG-135 treated and PBS control mice. But at day 25, tumour burden in NG-135 treated mice was significantly lower than the PBS control group (FIG. 36B). The extent of tumour burden in individual mouse lungs correlated with virus replication (FIG. 36C) and this selectivity of virus replication was further demonstrated by a ~2 log increase in detectable virus particles in the tumour nodules compared to the surrounding lung tissues that had no macroscopically visible tumour nodules (FIG. 36D).

Example 21

Comparison of NG-135 and EnAd Activity in a Murine Orthotopic Xenograft Model of Ovarian Cancer SKOV-3 ovarian carcinoma cells stably expressing luciferase were implanted into CB17-SCID mice via intraperitoneal injection of 5e6 cells/mouse. 22 days post implantation mice were treated with either PBS (control) or 5e7 EnAd, NG-135 or NG-78 virus particles delivered by intraperitoneal injection. The mice were imaged twice per week using an IVIS imaging camera following intraperitoneal injection of 32 mg of luciferin. The relative light units (RLU), as a measure of tumour burden, were determined for a fixed region of interest at different time points. The data show that EnAd, NG-135 and NG-78 viruses significantly reduce tumour burden in this model compared to PBS controls (FIG. 37).

Example 22

Characterisation of the NG-135 Virus and Expressed Anti-VEGF Antibody Following Scaled-Up Production and Purification of Virus Material from a Bioreactor HEK293 cells were thawed and expanded in shake flasks prior to expansion to a 3 L working volume in a 5 L stirred-tank (glass vessel) bioreactor. The bioreactor controller was set to parameters of 37° C., a pH setpoint of 7.4, dissolved oxygen (DO) of 50, an airflow rate of 100 mL/min, and the agitation at 100 rpm. After the bioreactor system was equilibrated, an initial volume of 1.5L EX-CELL culture medium is seeded with HEK293 cells at a viable cell density of $5\times10^5$ cells/mL and then expanded to a working volume of 3 L and once the cells had expanded to the appropriate density the culture was infected with NG-135 at an MOI of 50 ppc. At 48 hrs post infection the 3L culture was harvested and virus was purified from it by processes previously established for GMP manufacture of EnAd virus (outlined below) such that the NG-135 virus produced could be compared to previously manufactured EnAd virus. In addition to purifying the virus, anti-VEGF antibody produced by the infected cells was also purified from the cell culture media to allow structural and functional analyses to be made for comparison with the bevacizumab clinical product, Avastin.

NG-135 Virus Purification

NG-135 virus was purified from the bioreactor harvest. The harvested material was treated with Benzonase® to digest host cell DNA and then concentrated and buffer exchanged by tangential flow filtration (TFF) using a 500 kD hollow fibre membrane. At this step the TFF permeate, which would normally be discarded, was collected and used for purification of the anti-VEGF antibody (see below). The concentrated TFF retained material, containing the NG-135 virus, was purified by selective capture and elution of NG-135 virus using a Sartobind anion exchange chromatography resin. The purified virus was then buffer exchanged into 50 mM Tris-HCl, 2 mM $MgCl_2$, 5% glycerol buffer, titred by HPLC, and stored at −80 degrees.

NG-135 Virus Characterisation

The purified NG-135 virus batch (named NG-135-BR1) oncolytic activity (assessed by cell viability assay), virus replication (assessed by qPCR) and antibody expression (assessed by ELISA) was compared to EnAd or previously characterised NG-135 reference material.

For assessment of oncolytic potency compared to EnAd a cell viability assay was carried out according to methods detailed in Example 15. The purified NG-135-BR1 showed similar potency to manufactured EnAd reference material (FIG. 38A).

For assessment of virus replication or antibody expression, HT-29 cells were seeded in 12 well culture plates at a density of 1e6 cells/well, allowed to adhere and then infected with 100 ppc of EnAd, NG-135 or NG-135-BR1.

For qPCR, DNA was harvested at 24, 48 or 72 hrs post infection from both cellular lysates and supernatants according to methods detailed in example 18. The extracted DNA samples were analysed against EnAd standards by qPCR using a EnAd E3 gene specific primer-probe set according to the methods detailed in Example 9. Total virus genomes detected throughout the infection time course was the same for all the viruses tested (FIG. 38B).

For assessment of anti-VEGF antibody expression, clarified infection supernatants were diluted in to PBS/3% BSA/

0.05% Tween 20 then assayed by ELISA against a bevacizumab standard curve according to methods detailed in Example 18. The concentration of antibody was determined by interpolating from the standard curve (FIG. 38C).

Anti-VEGF Antibody Purification

The collected TFF permeate, containing the anti-VEGF monoclonal antibody, was concentrated and buffer exchanged into Protein A diafiltration buffer (200 mM Na$_2$PO$_4$, pH 7.0) using a second TFF step with a 30 kD hollow fibre membrane. The concentrated antibody was purified by Protein A chromatography with a 1 ml Protein A column on an AKTA purifier system. The eluted antibody fraction was concentrated using an Amicon Ultra 50 kD concentrator and buffer exchanged into a storage buffer (50 mM Tris-HCl, 5% glycerol, pH7.0) using a PD10 column. The concentration of purified antibody was determined by OD- as 0.15 mg/ml and purity was confirmed by SDS-PAGE.

Characterisation of Purified Anti-VEGF Antibody

The structure of the purified anti-VEGF antibody was compared to clinical Avastin by western blot following non-reduced or reduced SDS-PAGE and the affinity of the antibody to VEGF was assessed by Biacore. For western blot, 7.5 µg/ml of Avastin or 6 µg/ml of purified antibody product was prepared in NuPAGE LDS sample buffer. For reducing gels NuPAGE reducing agent was also added to each sample before all samples were heated for 10 mins, 70° C. SDS-PAGE was carried out using 4-12% Bis-Tris NuPAGE gels according to the manufacturer's protocol. Proteins were transferred onto PVDF membranes by western blot using the Xcell II Blot Module. Blocking and immunoblotting was carried out in PBS 0.1% Tween-20 supplemented with 5% milk powder. Anti-VEGF antibodies were detected using HRP conjugated polyclonal anti-human IgG (Promega, W4031). Proteins were visualised by enhanced chemiluminescence (ECL). Purified anti-VEGF antibody produced from the NG-135 virus production process showed comparable detectable protein bands on the non-reduced and reduced blots as Avastin (FIG. 38D).

For analysis of the VEGF binding affinity of the purified antibody material compared to Avastin, the material was assayed using a validated VEGF-binding Biacore assay (carried out by BioOutsource, UK). Kinetic analysis (Biacore T200 Evaluation Software) following the defined assay protocol demonstrated that the purified anti-VEGF antibody sample was able to bind VEGF165 with similar kinetics and affinity to the Avastin reference standard material (FIG. 38E).

Example 23

Production and Characterisation of EnAd Viruses Encoding Anti-VEGF Monoclonal Antibody Chains Linked by a Self-Cleavable P2A Peptide (NG-165)

The plasmid pEnAd2.4 (SEQ ID NO: 64) was used to generate the plasmid pNG-165 (SEQ ID NO: 59) by direct insertion of a transgene cassette encoding an anti-VEGF antibody into the unique restriction sites located between the L5 and E4 genes. The pNG-165 transgene cassette encodes an anti-VEGF antibody by inclusion of an anti-VEGF VH chain sequence (SEQ ID NO: 29), an antibody constant heavy chain sequence (SEQ ID NO: 33), a high self-cleavage efficiency P2A peptide sequence (SEQ ID NO: 25), an anti-VEGF VL chain sequence (SEQ ID NO: 31) and an antibody constant light chain sequence (SEQ ID NO: 35). The antibody coding sequence is flanked by a 5' short splice acceptor sequence (SEQ ID NO: 16) and a 3' polyadenylation sequence (SEQ ID NO: 20). A schematic of the inserted transgene cassette is shown in FIG. 34. Construction of the plasmid was confirmed by DNA sequencing.

Virus Production

The virus NG-165 was amplified and purified according to methods used to purify the NG-135 virus detailed in Example 8.

Virus Characterisation

NG-165 oncolytic activity (assessed by cell viability assay), virus replication (assessed by qPCR) and anti-VEGF antibody expression (assessed by ELISAs) was compared to EnAd or NG-135 in colon carcinoma cells. For assessment of oncolytic potency compared to EnAd a cell viability assay was carried out according to methods detailed in Example 15. The NG-165 virus showed similar potency to manufactured EnAd reference material (FIG. 39A).

For assessment of virus replication or antibody expression, HT-29 cells were seeded in 12 well culture plates at a density of 1e6 cells/well, allowed to adhere and then infected with 100 ppc of EnAd, NG-135 or NG-165. For qPCR, DNA was harvested at 24, 48 or 72 hrs post infection from both cellular lysates and supernatants according to methods detailed in example 18. The extracted DNA samples were analysed by qPCR using a EnAd E3 gene specific primer-probe set according to the methods detailed in Example 9. Total virus genomes detected for NG-165 throughout the infection time course was similar to EnAd reference virus (FIG. 39B)

For assessment of anti-VEGF antibody expression, clarified infection supernatants 24, 48 or 72 hrs post-infection were diluted in to PBS/3% BSA/0.05% Tween 20 then assayed by IgG1 ELISA using a bevacizumab standard curve according to methods detailed in Example 18. The concentration of IgG1 antibody was determined by interpolating from the standard curve and indicated that NG-165 expresses similar levels of IgG1 to the NG-135 reference virus (FIG. 39C).

Example 24

Characterisation of EnAd Viruses Encoding Anti-VEGF ScFvs Under Control of Endogenous or Exogenous Promoters The NG-76 and NG-78 viruses, previously described in examples 8 and 11, were further characterised for their oncolytic activity in colon carcinoma cells (assessed by cell viability assay) and expression of functional anti-VEGF ScFv protein (assessed by VEGF binding ELISA). For assessment of oncolytic potency compared to EnAd cell viability assays were carried out according to methods detailed in Example 15. Both NG-76 and NG-78 showed similar oncolytic potency to manufactured EnAd reference material (FIGS. 40A and 40B).

For NG-76, the binding activity of the anti-VEGF scFv expressed under an exogenous (CMV) promoter is described in example 12. For NG-78 the binding activity of the anti-VEGF scFv expressed from the endogenous virus major late promoter was assessed by either direct VEGF binding ELISA or in an ELISA where bevacizumab clinical product is included to compete for VEGF binding. For both ELISAs 293F cells were infected with 50 ppc NG-78 virus and cultured for 70 hrs. The cells and media were harvested from the flask and the supernatant and cells were separated by centrifuging for 10 mins, 1000 rpm. The supernatant was collected and the remaining cell pellet resuspended in 1 ml of cell media before carrying out 3 freeze-thaw cycles to lyse the cells. Post-lysis the cell debris and media was separated by a second centrifugation step and the supernatant from the lysate was collected. The supernatants or lysates were diluted 1 in 2 in 3% BSA/PBS 0.05% tween. For the direct binding ELISA the samples were further serially diluted to a lowest dilution of 1 in 1024. For the competition ELISA the samples had bevacizumab added to them at concentrations of 0, 0.05, 0.5 or 5 μg/ml. ELISA plates were coated with VEGF, blocked and washed according to methods detailed in example 7. Samples were added to the plates at 100 μl/well and incubated for 1 hr VEGF bound ScFv was detected using HRP-conjugated polyclonal anti-His (Abcam ab1187) followed by TMB detection. Absorbance was read at 450 nm on a plate reader and background subtracted absorbance is plotted for the direct binding of the samples to VEGF (FIG. 40C) and direct binding in the presence of increasing concentrations of bevacizumab (FIG. 40D). As previously demonstrated for NG-76, functional anti-VEGF ScFv that specifically binds VEGF165 can be expressed and secreted from NG-78 infected cells.

Example 25

Characterisation of NG-76 Virus Activity Compared to EnAd in Tumour Bearing Mice DLD colon carcinoma cells were implanted as a subcutaneous xenograft in CD1 nu/nu mice. Once tumours reached ~100 mm$^3$ mice were grouped and treated with 5e9 EnAd or NG-76 virus particles delivered by single intratumoural injection. In each study a group of uninfected control mice was also included. DLD tumours were resected day 7 post treatment and assessed for virus replication (by qPCR) and virus or anti-VEGF ScFv gene expression (by RTqPCR).

Analysis of Virus Genome Replication by qPCR

Resected tumours were weighed, homogenised and DNA extracted according to the methods detailed in Example 13. Extracted samples and standards were analysed by qPCR using an EnAd E3 gene specific primer-probe set according to the qPCR methods detailed in Example 9. Quantification of the number of virus genomes per tumour is shown for DLD tumours Day 7 post-treatment and demonstrates that NG-76 and EnAd have significant virus replication above input (FIG. 41A).

Analysis of Viral (Hexon) or Anti-VEGF ScFv Antibody Gene Expression by RTqPCR cDNA was prepared from RNA of resected tumours according to the methods detailed in example 13. Quantification of the number of cDNA copies detected by qPCR demonstrated comparable expression of the virus late gene, hexon, in NG-76 or EnAd treated DLD tumours Day 7 post-treatment (FIG. 41B). In contrast, anti-VEGF ScFv gene expression was only detected in DLD cells treated with the NG-76 virus (FIG. 41C).

Example 26

Selectivity of Expression in Cells or Tumours of Virus Encoded Transgenes by Utilising Endogenous or Exogenous Promoters (NG-135, NG-47, NG-61, NG-63 and NG-107)

NG-135 Antibody Expression is Dependent on Virus Replication

The anti-VEGF antibody cassette in the NG-135 virus is encoded under the control of the EnAd endogenous Major Late Promoter (MLP). It has been previously characterised that during adenovirus infection the majority of gene expression from the major late promoter is dependent on virus replication. To demonstrate that antibody expression when controlled by the EnAd MLP is therefore also dependent on virus replication the kinetics of NG-135 virus replication (assessed by qPCR) and antibody expression (assessed by ELISA) were compared at different MOIs.

HT-29 colon carcinoma cells were seeded in 6 well plates at a density of 2e6 cells/well. 18hrs post-seeding the cells were infected with 1, 10 or 100 ppc of NG-135 virus.

For assessment of anti-VEGF antibody expression, clarified infection supernatants 24, 48 or 72 hrs post-infection were diluted in to PBS/3% BSA/0.05% Tween 20 then assayed by anti-VEGF binding ELISA according to the methods detailed in example 9. The concentration of antibody was determined by interpolating from the standard curve.

For analysis of virus replication by qPCR, DNA was harvested at 24, 48 or 72 hrs post infection from both cellular lysates and supernatants according to methods detailed in example 9. The extracted DNA samples were analysed by qPCR using a EnAd E3 gene specific primer-probe set according to the methods detailed in Example 9. Analysis of antibody expression 72 hrs post infection shows detectable secreted antibody for all MOIs tested but the level of antibody expression is dependent on input MOI (FIG. 42A). The kinetics of antibody expression show antibody expression increases over the course of infection but detectable antibody expression is associated with a significant level of virus replication above input (FIGS. 42B and 42C).

NG-135 Antibody Expression in Carcinoma, Stromal Fibroblast and Primary Cells

To confirm that antibody can be selectively expressed in cells permissive to NG-135 infection and virus replication, NG-135 virus replication (assessed by qPCR), antibody expression (assessed by ELISA) and ability to produce infectious virus particles (assessed by re-infection assay) was determined in cancer cells (HT-29) known to be permissive to EnAd infection and fibroblasts cells (WI-38 and MRC-5) previously characterised to be non-permissive. Briefly, cells were seeded in 12 well plates and infected 18 hrs post-seeding with 100 ppc NG-135 virus for 4 hrs before the infection media was removed from the cells and replaced with culture media. At 1 hr or 72 hrs post the 4 hr infection period, cell supernatants and lysates were harvested from the plates according to methods detailed in example 18. For qPCR, DNA was extracted and samples were analysed using an EnAd E3 gene specific primer-probe set according to the methods detailed in Example 9. For assessment of anti-VEGF antibody expression, clarified infection supernatants post-infection were diluted in PBS/3% BSA/0.05% Tween 20 then assayed by ELISA according to methods detailed in Example 18.

For assessment of infectious virus particle production, harvested supernatants were 10-fold serially diluted from neat and used to re-infect fresh cultures of HT-29 cells seeded at a density of 3e4 cells/well in 96 well plates. Media were removed from the plates 72 hrs post-reinfection and the cells fixed with Me:Ac for 10 mins at RT. Wells were then washed with PBS and the cells stained for EnAd capsid protein expression by incubation with rabbit anti-hexon primary antibody (diluted 1 in 800) then secondary HRP-coupled anti-rabbit detection antibody. The hexon protein was visualised by addition of DAB substrate and imaging using light microscopy. Infectious titre (TCID50/ml) was determined by scoring all wells containing positive capsid protein staining.

Data analysis revealed that only HT-29 cells showed NG-135 virus replication above infection input levels (FIG. 43A) or detectable antibody expression (FIG. 43B). Using the IgG1 ELISA assay sensitivity information, the lack of detectable antibody expression by non-tumour cells indicates that these cells produced less than 0.33 fg/cell/24 h compared with levels of over 100 fg/cell/24 h for HT-29 tumour cells. These data correlated with extensive production of infectious virus particles in HT-29 tumour cells but no detectable virus production in the fibroblast cell lines (FIG. 43C).

Selective Expression of Transgenes in Primary Immune Cells

Selective expression of transgenes in primary innate immune cells was characterised for EnAd viruses, NG-47 and NG-107, which express the reporter gene, eGFP, under the control of an exogenous (CMV) promoter or the endogenous MLP, respectively. NG-47 and NG-107 virus characterisation is detailed in example 14.

Monocytes were isolated from whole blood and cultured to differentiate into dendritic cells according to the methods detailed in example 28. At day 5 of culture differentiated monocyte derived dendritic cells were seeded into 96 well plates and exposed to 200 ppc of EnAd, NG-47 or NG-107 or left untreated. After 48 hrs cells were collected from the wells, washed and labelled with PE/Cy5 conjugated anti-CD83 antibody (CD83-PE/Cy5 (BioLegend)). CD83 and eGFP expression on the DCs was then assessed by flow cytometry (Applied Biosystems) and data was analysed using FlowJo software. GFP expression could only be detected in cells exposed to NG-47 where eGFP expression is under the exogenous CMV promoter which is not dependent on viral replication for gene expression (FIG. 44).

Selective Expression of Transgenes in In Vivo Models

To investigate the selectivity of transgene expression in vivo, reporter viruses were used to determine transgene expression in murine carcinoma cell tumours known to be non-permissive to EnAd virus replication. Transgene expression and the functional immune response to the transgene, virus or tumour where assessed when transgene expression was under the control of either an exogenous (CMV) promoter or the endogenous MLP.

Reporter viruses NG-61 and NG-63, which express the luminescent protein, luciferase, were previously described and characterised in Example 14. BALB/c mice were implanted with 1e$^6$ murine colon carcinoma cells (CT26) subcutaneously on their flank. Once an average size of approximately 100 mm$^3$ was reached, tumours were injected with 2.5e$^9$ particles of either NG-61 or NG-63. Mice were imaged regularly for 14 days post-treatment using an IVIS imaging camera following intraperitoneal injection of 32 mg of luciferin. Regions of interest of a fixed size were drawn around the tumours to allow measurement of relative light units (RLU) for each tumour. Untreated tumour bearing mice were also imaged to determine imaging background. Quantification of transgene expression across the treatment groups demonstrated that luciferase was only detectable in tumours treated with NG-61 virus, in which luciferase is under the control of the exogenous CMV promoter (FIG. 45A).

At day 14 post-treatment spleens were resected from the mice and dissociated. An anti-interferon gamma antibody was immobilised on PVDF plates. Splenocytes and stimuli, either EnAd virus, CT26 cell lysates or trypsin digested recombinant luciferase protein, were added to the PVDF plates and incubated overnight. Plates were then washed and incubated with a biotin labelled anti-interferon gamma antibody before being washed again and incubated with a streptavidin-ALP conjugate. Plates were then washed, BCIP/NBT substrate was added and then the plates were left to develop until distinct spots could be seen. The plates were washed again and then dried before analysis was carried out at CTL Europe, Germany. Quantification revealed that splenocytes from NG-61 but not NG-63 treated mice showed specific responses to the luciferase transgene (FIG. 45B). This result correlated with increased responses in NG-61 treated mice to both the EnAd virus and CT26 tumour cells (FIGS. 45C and 45D).

Example 27

Production and Characterisation EnAd Viruses Encoding Antibodies (NG-190, NG-177) or ScFv Antibody Variants (NG-221) to the Immune-Checkpoint Inhibitor Pathway Protein PD-L1

The plasmid pEnAd2.4 (SEQ ID NO: 64) was used to generate the plasmids pNG-177 (SEQ ID NO: 46 described in example 16), pNG-190 (SEQ ID NO: 60),) and pNG-221 (SEQ ID NO: 61) by direct insertion of transgene cassettes encoding either anti-PD-L1 antibody (YW243) or anti-PD-L1 ScFv of the YW243 antibody, into the unique restriction sites located between the L5 and E4 genes. The pNG-177 transgene cassette encodes an anti-PD-L1 antibody by inclusion of an anti-PD-L1 VH chain sequence (SEQ ID NO: 30), an antibody constant heavy chain sequence (SEQ ID NO: 34), an internal ribosome entry sequence (SEQ ID NO. 19), an anti-PD-L1 VL chain sequence (SEQ ID NO: 32) and an antibody constant light chain sequence (SEQ ID NO: 35). The pNG-190 transgene cassette encodes an anti-PD-L1 antibody by inclusion of an anti-PD-L1 VH chain sequence (SEQ ID NO: 30), an antibody constant heavy chain sequence (SEQ ID NO: 34), a high self-cleavage efficiency P2A peptide sequence (SEQ ID NO: 25), an anti-PD-L1 VL chain sequence (SEQ ID NO: 32) and an antibody constant light chain sequence (SEQ ID NO: 35). The pNG-221 transgene cassette encodes an anti-PD-L1 ScFv (SEQ ID NO: 37). The antibody or ScFv coding sequences are flanked by a 5' short splice acceptor sequence (SEQ ID NO: 16) and a 3' polyadenylation sequence (SEQ ID NO: 20). Schematics of the inserted transgene cassettes are shown in FIG. 34. Construction of the plasmids was confirmed by DNA sequencing.

Virus Production

The viruses NG-190 and NG-221 were amplified and purified according to methods used to purify the NG-135 virus detailed in Example 8.

Virus Characterisation

NG-190 and NG-221 oncolytic activity (assessed by cell viability assay), virus replication (assessed by qPCR) and anti-PD-L1 antibody or ScFv expression in colon carcinoma cells (assessed by ELISA) was compared to either EnAd reference virus or NG-165, NG-135 viruses which have been previously characterised and express anti-VEGF antibody. For assessment of oncolytic potency compared to EnAd a cell viability assay was carried out according to methods detailed in Example 15. The NG-190 and NG-221 viruses showed similar oncolytic activity to EnAd (FIGS. 46A,B).

For assessment of virus replication or antibody expression, HT-29 cells were seeded in 12 well culture plates at a density of 1e6 cells/well and after adhering infected with 100 ppc of EnAd, NG-190, NG-221 or NG-165. For qPCR, DNA was harvested at 24, 48 or 72 hrs post infection from both cellular lysates and supernatants according to methods detailed in example 18. The extracted DNA samples were analysed by qPCR using an EnAd E3 gene specific primer-probe set according to the methods detailed in Example 9. Total virus genomes detected for NG-190 (FIG. 46C) or NG-221 (FIG. 46D) was similar to EnAd reference virus throughout the infection time course.

For assessment of secreted antibody expression from NG-190 or NG-165 infected cells, clarified infection supernatants harvested 24, 48 or 72 hrs post-infection were diluted in to PBS/3% BSA/0.05% Tween 20 then assayed by anti-human IgG1 ELISA according to methods detailed in Example 18. Similarly, secreted antibody expression from NG-177 or NG-135 infected cells was assessed in clarified supernatants 72 hrs post-infection. The concentration of antibody in the samples was determined by interpolating from the assay standard curve and demonstrated that detectable antibody is secreted from NG-190 infected cells at comparable levels to the comparator virus NG-165 (FIG. 47A) and from NG-177 infected cells at comparable levels to the comparator virus NG-135 (FIG. 49A).

Example 28

Characterisation of Anti-PD-L1 Antibody or ScFv Expressed from NG-190, NG-177 or NG-221 Infected Cells PD-L1 Direct Binding Assay The anti-PD-L1 binding activity of antibody or ScFv expressed from NG-190 and NG-221 infected cells was assessed by direct PD-L1 binding ELISA.

A549 lung carcinoma cells were infected for 72 hours with 100 ppc of NG-190, NG-221 or the control virus NG-165. Culture supernatants were harvested and concentrated at 300 g for 5 minutes to remove cell debris. Culture supernatants were then concentrated 10 fold by centrifugation in a 9K MWCO protein concentrator spin column (Pierce, 87748) for 20 minutes at 4000 g. ELISA plates (NunC Immuno MaxiSorp 96 well microplate) were coated with recombinant PDL1-Fc (0.5 µg/ml, R&D Systems, 156-67-100) overnight at 4° C. Plates were washed three times with PBS-0.05% Tween-20 then blocked with PBS/3% BSA/0.05% Tween 20. Serial doubling dilutions of concentrated supernatants were prepared in PBS/3% BSA/0.05% Tween 20 over a range of 1 in 2 to 1 in 2048 then added to the ELISA plate and incubated for 1 hour at room temperature.

For NG-190 and NG-165 samples, plates were washed three times with PBS-0.05% Tween-20 then 50 µl 1/8000 Anti-Kappa light chain antibody (Abcam, ab124727) was added to all wells. After incubation for 1 hour and washing, secondary detection was carried out using Goat Anti-Rabbit IgG H&L (HRP) (Abcam, ab6721). The plate was then developed by the addition of 50 ul/well 1-Step Ultra TMB-ELISA Substrate Solution (thermo, 34028). After 20 minutes the reaction was stopped by the addition of 50 µl 1M HCl and absorbance at 450 nm was measured and plotted. Anti-PD-L1 binding activity could be specifically detected in the supernatants of NG-190 infected A549 cells but not NG-165 infected A549 cells (FIG. 47B).

For NG-221 samples plates were washed three times with PBS-0.05% Tween-20 then 500 1:5000 Anti-6×His tag® antibody (HRP) (Abcam, ab1187) was added to all wells for 1 hour at room temperature then washed. The plate was developed by the addition of 50 ul 1-Step Ultra TMB-ELISA Substrate Solution (thermo, 34028). After 20 minutes the reaction was stopped by the addition of 50 µl 1M HCl and absorbance at 450 nm was measured. ScFv Anti-PD-L1 binding activity could be specifically detected in the NG-221 supernatants (FIG. 47C).

PD-L1 Receptor Binding Inhibition Assay

The blocking activity of anti-PD-L1 antibody expressed in the supernatant of NG-190 or NG-177 infected cells was assessed in a PD-L1 ligand:PD-1 receptor interaction assay.

293 cells were infected for 72 hours with 100 ppc of NG-190 or NG-177. Culture supernatants were harvested and concentrated according to the method detailed above. ELISA plates were coated with PDL1-Fc (2 µg/ml, R&D Systems, 156-B7-100) overnight at 4° C. Plates were washed three times with PBS then blocked with PBS/3% BSA /0.05% Tween 20 for one hour at room temperature. Serial doubling dilutions of concentrated supernatants were prepared in PBS then 45 ul of each dilution was added to the ELISA plate. 10 ng recombinant PD1-Fc (R&D Systems, 1086-PD-050) was added to each well and the plate incubated for 1 hour. All wells were then washed three times with PBS/0.05% Tween 20 and blocked for 10 minutes with PBS/3% BSA/0.05% Tween 20. Biotinylated affinity purified antibody to human PD-1 (R&D Systems, BAF1086) was then added to the wells at 0.4 µg/mlfor 1 hour. The wells were washed three times with PBS/0.05% Tween 20 before addition of a 1:200 dilution of streptavidin-HRP (R&D Systems, DY998) for 1 hr. The plate was developed by the addition of 50 ul 1-Step Ultra TMB-ELISA Substrate Solution (thermo, 34028). After 20 minutes the reaction was stopped by the addition of 50 µl 1M HCl and absorbance at 450 nm was measured. To determine the percent of PD-1 binding, measured absorbance values were expressed as a percentage of the control samples which did not contain anti-PD-L1 antibody. Anti-PD-L1 antibody secreted from NG-190 infected cells was able to inhibit PD-1 receptor binding in a dose-dependent manner (FIG. 47D). Similarly, neat supernatant from NG-177, but not NG-135 infected cells, was able to inhibit PD-1 receptor binding to PD-L1 by >50% (FIG. 49B)

Mixed Lymphocyte reaction (MLR)

The functional activity of anti-PD-L1 antibody expressed in the supernatant of NG-190 or NG-177 infected cells was assessed by the extent of T cell activation in a mixed lymphocyte reaction. Peripheral Blood Mononuclear Cells (PBMCs) were isolated from fresh human blood (Clinical Trials Laboratory Services) by centrifugation of 1:2 diluted blood over 13 ml of FicoII-Paque Plus (GE healthcare life sciences, 17-1440-02) at 1300 rpm for 30 minutes. CD14+ monocytes were isolated using human CD14 Microbeads (Miltenyi, 130-050-201) according to the manufacturers' protocol. Isolated monocytes were cultured in RPMI 1640 (life technologies, 11875-093) supplemented with 2 mM L-glutamine (GE Healthcare: M11-003), 1 mM Sodium pyruvate (GE Healthcare: S11-003), 1 mM non-essential amino acids (GE Healthcare: M11-004), 1 mM pen/strep (GE Healthcare: P11-010) and 10% FBS (Thermo fisher, 5V30160.03) 500 U/Wl IL-4 (R&D Systems, 204-IL-050) and 800 U/ml GM-CSF (R&D Systems, 215-GM-050). Cultures were fed every 2 days by replacing half the culture volume with fresh medium.

Monocyte derived dendritic cells were matured on day 5 of culture by the addition of 1 µg/ml LPS (Sigma-Aldrich, L2654) for 24 hours. The cells were used for the MLR assay on day 6.

CD4 T cells were isolated from PBMCs (isolated as described above) using a human CD4+ T Cell Isolation Kit (Miltenyi, 130-096-533) according to the manufacturers' protocol. Isolated CD4+ T cells were used in MLR on day of isolation.

For the MLR, 1e5 isolated CD4+ T cells per well were mixed with 2e4 LPS-matured monocyte-derived dendritic cells and then either positive control anti-PD-L1 antibody (5 µg/ml, Biolegend 329716) or 20 µl of concentrated supernatants (prepared above) were added to the test wells. The MLR was incubated for 4 days at 37° C. Supernatants were removed from the plate, clarified and then assayed for the cytokine IL-2 by ELISA. Briefly, ELISA plates were coated with human IL-2 mAb (R&D Systems, MAB602) overnight at 4° C. Plates were washed three times with PBS then blocked with PBS/3% BSA/0.05% Tween for one hour at room temperature. An IL-2 standard curve was prepared from recombinant IL-2 protein (R&D Systems, 202-IL-050) over a range of 2000 pg/ml to 31.3 pg/ml. MLR samples were prepared by diluting clarified supernatants prepared above 1 in 4 in PBS/3% BSA/0.05% Tween 20. Samples and standards were added at 50 µl/well to the ELISA plates for 1 hr RT then they were was washed three times with PBS/0.05% Tween 20 before addition of biotinylated anti-human IL-2 detection antibody (R&D Systems, BAF202). After 1 hr incubation the plate was washed a further three times with PBS/0.05% Tween 20 and 1:200 dilution of streptavidin-HRP (R&D Systems, DY998) was added for 1 hr. The plate was developed by the addition of 50 µl 1-Step Ultra TMB-ELISA Substrate Solution (thermo, 34028). After 20 minutes the reaction was stopped by the addition of 50 µl 1M HCl and absorbance at 450 nm was measured. For two different DC:T cell donor sets from independent experiments, enhanced CD4 T cell responses, in terms of increased IL-2 expression, could be detected for NG-190 infected culture supernatants but not for NG-165 (FIGS. 48A and 48B). Similarly, CD4 T cell responses were also enhanced for NG-177 but not NG-135 culture supernatants (FIG. 49C). Taken together these data demonstrate that functional anti-PD-L1 antibody is produced in the context of tumour cell infection for both NG-190 and NG-177 armed viruses.

Cellular PD-L1 Ligand Binding

The anti-PD-L1 binding activity of antibody expressed from NG-177 infected cells was assessed for its ability to directly binding non-recombinant PD-L1 ligand expressed in a membrane environment on the surface of lung carcinoma cells (A549).

A549 cells were either stimulated with 50 ng/ml human IFNγ to promote upregulation of PD-L1 expression on the cell surface or left unstimulated. After 24 hrs the cells were trypsinised and incubated for 1 hr at 4° C. with media only, or 50 µl of concentrated NG-177 or NG-135 infected cell supernatant (prepared above). The cells were washed twice with PBS/1% BSA before incubation for 30 min at 4° C. with 50 µl Alexa-fluor 488 labelled goat anti-human IgG (H+L) (LifeTechnologies, A11013) diluted 1 in 250. The cells were washed again, resuspended in PBS/1% BSA and analysed with an Attune acoustic focusing cytometer (Life Technologies). PD-L1 binding activity, which was similar to the binding of a PE-labeled purified anti-PD-L1 control antibody (29E.2A3 from Biolegend), could be detected in NG-177 supernatants, but was not detected in NG-135 control virus supernatants (FIG. 50).

Example 29

Production and Characterisation of EnAd Viruses Encoding Antibodies to the Immune-Checkpoint Inhibitor Pathway Protein CTLA-4 (NG-242)

The plasmid pEnAd2.4 was used to generate the plasmid pNG-242 (SEQ ID NO: 58) by direct insertion of transgene cassettes encoding an anti-CTLA-4 antibody (11.2.1) into the unique restriction sites located between the L5 and E4 genes. The pNG-242 transgene cassette encodes an anti-CTLA-4 antibody by inclusion of an anti-CTLA-4 VH chain sequence (SEQ ID NO: 70), an antibody constant heavy chain sequence (SEQ ID NO: 33), an internal ribosome entry sequence (SEQ ID NO: 19), an anti-CTLA-4 VL chain sequence (SEQ ID NO: 71) and an antibody constant light chain sequence (SEQ ID NO: 35). A Schematic of the inserted transgene cassettes is shown in FIG. 34. Construction of the plasmid was confirmed by DNA sequencing.

Virus Production

The virus NG-242 was amplified and purified according to methods used to purify the NG-135 virus detailed in Example 8.

Virus Characterisation

NG-242 oncolytic activity (assessed by cell viability assay) and anti-CTLA-4 antibody expression (assessed by ELISA) was compared in colon carcinoma cells to either EnAd reference virus or NG-135 reference virus which express anti-VEGF antibody. For assessment of oncolytic potency compared to EnAd a cell viability assay was carried out according to methods detailed in Example 15. The NG-242 virus showed comparable potency to manufactured EnAd reference material (FIG. 51A)

For assessment of antibody expression, HT-29 cells were seeded in 12 well culture plates at a density of 1e6 cells/well and after adhering infected with 100 ppc of EnAd, NG-242 or NG-135. Infection supernatants harvested at 24, 48 or 72 hrs post infection were diluted in to PBS/3% BSA/0.05% Tween 20 then assayed by anti-human IgG1 ELISA according to methods detailed in Example 18. The concentration of antibody in the samples was determined by interpolating from the assay standard curve and demonstrated that detectable antibody is secreted from NG-242 infected cells at similar levels to the comparator virus NG-135 (FIG. 51B).

CTLA-4 Direct Binding Assay

The anti-CTLA-4 binding activity of antibody expressed from NG-242 infected cells was assessed by direct CTLA-4 binding ELISA.

A549 cells were infected for 72 hours with 100 ppc of NG-242 or NG-165 control virus, which expresses an IgG1 anti-VEGF antibody. Culture supernatants were harvested and concentrated at 300 g for 5 minutes to remove cell debris. ELISA plates were coated with recombinant CTLA4-Fc (0.5 µg/ml, R&D Systems, 325-CT-200) overnight at 4° C. Plates were washed three times with PBS/0.05% Tween 20 then blocked with PBS/3% BSA/0.05% Tween 20. Serial doubling dilutions of concentrated supernatants were prepared in PBS/3% BSA/0.05% Tween 20 from 1 in 2 to 1 in 2048 then added to the ELISA plate and incubated for 1 hour at room temperature. This ELISA was then processed according to the methods for detecting PD-L1 binding detailed in example 28. Anti-CTLA-4 binding activity could be specifically detected in the supernatants of NG-242 infected A549 cells but not NG-165 infected A549 cells (FIG. 51C).

CTLA-4 Receptor Binding Inhibition Assay

The blocking activity of anti-CTLA-4 antibody expressed in the supernatant of NG-242 infected cells was assessed in a CTLA-4 ligand:B7-1 receptor interaction assay.

Culture supernatants from NG-242 infected cells described above were harvested and concentrated according to methods detailed in example 28. ELISA plates were coated with CTLA4-Fc (2 µg/ml, R&D Systems, 325-CT-200) overnight at 4° C. Plates were washed three times with PBS then blocked with PBS/3% BSA/0.05% Tween 20 for 1 hour at room temperature. Serial doubling dilutions of concentrated supernatants were prepared in PBS then 45 μl of each dilution was added to the ELISA plate. 10 ng recombinant B7-1-Fc (R&D Systems, 140-B1-100) was added to each well and the plate incubated for 1 hour. All wells were then washed three times with PBS/0.05% Tween 20 then blocked for 10 minutes with PBS/3% BSA/0.05% Tween 20. 2 μg/ml of biotinylated anti-human B7-1 antibody (R&D Systems, BAM-402) was added and the plate incubated for 1 hour. Three washes were carried out then a 1:200 dilution of streptavidin-HRP (R&D Systems, DY998) was added. The plate was developed by the addition of 50 μl 1-Step Ultra TMB-ELISA Substrate Solution (thermo, 34028). After 20 minutes the reaction was stopped by the addition of 50 μl 1M HCl and absorbance at 450 nm was measured. Results were analysed by dividing sample absorbance by that of the control (with no test inhibitor) and multiplying by 100 to determine the percent of maximum B7-1 bound. Anti-CTLA-4 antibody secreted from NG-242 infected cells was able to inhibit B7-1 receptor binding (FIG. 51D).

Example 30

Production and Characterisation of EnAd Viruses Encoding Tumour Associated Antigens (TAAs) (NG-217, NG-220)

The plasmid pEnAd2.4 (SEQ ID NO: 64) was used to generate the plasmids pNG-217 (SEQ ID NO: 57), pNG-220 (SEQ ID NO: 56) by direct insertion of transgene cassettes encoding the tumour associated antigen, NY-ESO-1 into the unique restriction sites located between the L5 and E4 genes. The pNG-217 transgene cassette encodes the NY-ESO-1 gene (SEQ ID NO: 43) flanked by a CMV promoter sequence (SEQ ID NO: 13) and a 3' polyadenylation sequence (SEQ ID NO: 20). The pNG-220 transgene cassette encodes the NY-ESO-1 gene flanked by a PGK promoter sequence (SEQ ID NO: 14) and a 3' polyadenylation sequence (SEQ ID NO: 20). Schematics of the inserted transgene cassettes are shown in FIG. 34. Construction of the plasmids was confirmed by DNA sequencing.
Virus Production The viruses NG-217 and NG-220 were amplified and purified according to methods used to purify the NG-135 virus detailed in Example 8.
Virus Characterisation NG-220 and NG-217 virus replication (assessed by qPCR) and NG-220 NY-ESO-1 transgene expression in colon carcinoma cells (assessed by western blot) was compared to EnAd. For assessment of virus replication HT-29 cells were seeded in 12 well culture plates at a density of 1e6 cells/well and after adhering infected with 100 ppc of EnAd, NG-220 or NG-217. For qPCR, DNA was harvested at 24 or 48 post infection from both cellular lysates and supernatants according to methods detailed in example 18. The extracted DNA samples were analysed by qPCR using an EnAd E3 gene specific primer-probe set according to the methods detailed in Example 9. Total virus genomes detected for NG-220 (FIG. 52A) or NG-217 (FIG. 52B) was similar to EnAd reference virus.

For assessment of NY-ESO-1 expression western blot, HT-29 cells were seeded in 6 well culture plates at a density of 4e6 cells/well and were incubated for 5 hrs at 37° C., 5% $CO_2$. The cells were then infected for 48 or 72 hrs with 100 NG-220 or EnAd virus particles per cell. Media was removed from the wells and the cells were washed once with PBS before lysis in 2500 lysis buffer (150 mM NaCl, 1% Triton X-100, 0.5% SDS, 50 mM Tris-HCl (pH7.5)) containing anti-protease inhibitor cocktail III (Calbiochem: 539134). The lysates were treated with benzonase to degrade genomic DNA and were further diluted 1:4 in lysis buffer containing NuPAGE LDS sample buffer and NuPAGE reducing agent (Life Technologies). The samples were heated for 10 mins, 70° C. before carrying out SDS-PAGE using 4-12% Bis-Tris NuPAGE gels (Life Technologies) according to the manufacturer's protocol. Proteins were transferred onto PVDF membranes by western blot using the XcelI II Blot Module (Life Technologies). Blocking and immunoblotting was carried out in PBS 0.1% Tween-20 supplemented with 5% milk powder and all wash steps were carried out in PBS 0.1% Tween-20. NY-ESO-1 was detected using mouse monoclonal anti-NY-ESO-1 antibody (3 μg/ml) and secondary antibody detection was carried out using Rabbit anti-mouse IgG-HRP. Proteins were visualised by enhanced chemiluminescence. NY-ESO-1 expression was detectable at both 48 and 72 hrs post infection with NG-220 but not EnAd control (FIG. 52B).

Example 31

Construction of an EnAd Cloning Plasmid, pEnAd2.4, for the Insertion of Transgene Cassettes Downstream of the L5, Fibre, Gene The plasmid pEnAd2.4 (SEQ ID NO: 64) was obtained by homologous recombination between a shuttle vector, pEnAd2.4 Shuttle, and the EnAd genome. The pEn2.4 plasmid contains a bacterial p15A origin of replication, a kanamycin resistance gene and the EnAd genome with unique restriction sites inserted in the $B_Y$ region.

The construction of the pColoAd2.4 plasmid was as follows. A ~12 kb shuttle plasmid, pColoAd1 Shuttle, was initially constructed in order that unique restriction sites could be inserted in the late gene, L5, region of the EnAd genome (region $B_Y$). The 5' (nt 1-4632) and 3' (nt 27837-32326) ends of EnAd were amplified from the EnAd genome by PCR using the primer 5'-TTGGCGGCGCGC-CTATCTATATAATATACC-3' [SEQ ID NO: 80] and primers 5'-AATGCAAATCTGTGAGGGG-3' [SEQ ID NO: 82] or 5'-CTTAGTGGTGTTGTGGTATTGG-3' [SEQ ID NO: 83] respectively. The 5' arm PCR product contained a 5' introduced AscI site and 3' PspOMI site that corresponds to the PspOMI site at nt 4626 in the EnAd genome. The 3' arm PCR product contained a 5' PspOMI site that corresponds to the PspOMI site at nt 27837 in the EnAd genome and a introduced 3' AscI site. The PCR products were restriction digested with AscI/PspOMI and ligated in a one-step three-way ligation into an AscI linearised plasmid that contained a p15A origin of replication and a kanamycin resistance cassette. This generated the pEnAd Shuttle plasmid. A DNA fragment corresponding to the region of the EnAd genome that is flanked by PspOMI and AdI restriction sites and contains the late gene, L5, (nt 27837-30060) was synthesised with an added region of 19 bp 5'-GCGATCGCTAC-CCTGCAGG-3' [SEQ ID NO: 90] inserted at position corresponding to EnAd nt 29356 in the region $B_Y$. This additional region included restriction sites for two enzymes that are not present in the EnAd genome (GCGATCGC and CCTGCAGG), and can be cut by SgfI and SbfI. The synthesised DNA fragment was restriction digested with the enzymes PspOMI and AdI and cloned into the corresponding region in the PspOMI/AcII digested pColoAdI shuttle plasmid to create the plasmid, pColoAd2.4 shuttle. To obtain the pColoAd2.4 plasmid by homologous recombination, the pColoAd2.4 shuttle plasmid was linearised by restriction digest with the enzyme PspOMI and treated with alkaline phosphatase to remove 5' phosphates. The linearised plasmid and the EnAd genome were co-transformed into BJ5183 cells by electroporation according to the manufacturer's protocol and the generation of the pColoAd2.4 plasmid by homologous recombination was determined by restriction digest. Correct construction of all plasmids was confirmed by DNA sequencing.

Example 32

Synthesis of an EnAd Cloning Plasmid, pColoAd2.6, for the Insertion of Transgene Cassettes Upstream or Downstream of the Fibre, Gene The plasmid pColoAd2.6 (pNG-185, SEQ ID NO: 65) was generated by synthetic gene segment assembly methods by SGI-DNA (La Jolla, Calif., USA). Correct construction of the plasmid was confirmed using next generation sequencing (SGI-DNA). The pNG-185 plasmid contains a bacterial p15A origin of replication, a kanamycin resistance gene and the EnAd genome with unique restriction sites inserted in the $B_X$ and $B_Y$ regions.
Virus Production The virus NG-185 was amplified and purified according to methods used to purify the NG-135 virus detailed in Example 8.
Virus Characterisation NG-185 oncolytic activity (assessed by cell viability assay) and virus replication (assessed by qPCR) was compared to EnAd reference virus. For assessment of oncolytic potency compared to EnAd a cell viability assay was carried out according to methods detailed in Example 15. The NG-185 virus showed similar oncolytic activity to EnAd (FIG. 53A).

For assessment of virus replication, HT-29 cells were seeded in 12 well culture plates at a density of 1e6 cells/well and after adhering infected with 100 ppc of EnAd, or NG-185. For qPCR, DNA was harvested at 48 or 72 hrs post infection from both cellular lysates and supernatants according to methods detailed in example 18. The extracted DNA samples were analysed by qPCR using an EnAd E3 gene specific primer-probe set according to the methods detailed in Example 9. Total virus genomes detected for NG-185 (FIG. 53B) was similar to EnAd reference virus throughout the infection time course.

Example 33

Production of EnAd Viruses from the Plasmid pColoAd2.6 (pNG-185)

The plasmid pEnAd2.6 (SEQ ID NO: 65), was used to generate the plasmids pNG-257 and pNG-281 by direct insertion of transgene cassettes into the pEnAd2.6 unique restriction sites located in the regions $B_X$ and $B_Y$. pNG-257 contains a transgene cassette encoding an anti-VEGF ScFv (SEQ ID NO: 36) with a C-terminal His peptide tag (SEQ ID NO: 23), flanked by a 5' bSA (SEQ ID NO: 18) and 3' poly(A) sequence (SEQ ID NO: 20) inserted in region $B_X$. pNG-281 contains transgene cassettes encoding an anti-VEGF ScFv (SEQ ID NO: 36) with a C-terminal Histidine peptide tags (SEQ ID NO: 23), flanked by a 5' bSA (SEQ ID NO: 18) and 3' poly(A) sequence (SEQ ID NO: 20) inserted in region $B_X$ and a second transgene cassette encoding an anti-PD-L1 ScFv (SEQ ID NO: 37) with a V5 tag (SEQ ID NO: 24) flanked by a 5' SSA (SEQ ID NO: 16) and 3' poly(A) sequence (SEQ ID NO: 20) inserted in region $B_Y$. Schematics of the inserted transgene cassettes in plasmids pNG-257 and pNG-281 are shown in FIG. 54. Construction of plasmids was confirmed by DNA sequencing. These plasmids contain the EnAd virus genomes NG-257 (SEQ ID NO: 72) and NG-281 (SEQ ID NO: 73).

Example 34

Production of EnAd Viruses Expression Multiple ScFv Antibody Variants

The plasmid pEnAd2.4 (SEQ ID NO: 64) was used to generate the plasmid pNG-272 by direct insertion of a cassette encoding an anti-VEGF ScFv and an anti-PD-L1 ScFv into the unique restriction sites located between the L5 and E4 genes (region $B_Y$). The pNG-272 transgene cassette encodes an anti-PD-L1 ScFv and anti-VEGF ScFv by inclusion of an anti-PD-L1 ScFv sequence (SEQ ID NO: 37), a high self-cleavage efficiency P2A peptide sequence (SEQ ID NO: 25), an anti-VEGF ScFv sequence (SEQ ID NO. 36) and a 3' polyadenylation sequence (SEQ ID NO: 20). Schematics of the inserted transgene cassettes are shown in FIG. 54. Construction of the plasmids was confirmed by DNA sequencing.
Virus Production The virus NG-272 (SEQ ID NO: 69) is amplified and purified according to methods used to purify the NG-135 virus detailed in Example 8.

Example 35

Production of EnAd Viruses Encoding the Transmembrane Protein, Sodium/Iodide Symporter (NIS)

The plasmid pEnAd2.4 (SEQ ID NO: 64) is used to generate the plasmid pNG-280 by direct insertion of a transgene cassette encoding the sodium iodide symporter (NIS) into the $B_Y$ region. The pNG-280 cassette contains a 5' SSA (SEQ ID NO: 16), NIS cDNA sequence (SEQ ID NO: 67) and a 3' poly(A) sequence (SEQ ID NO: 20) and encodes the NG-280 virus genome (SEQ ID NO: 68). Schematics of the inserted transgene cassettes are shown in FIG. 54. Construction of the plasmids is confirmed by sequencing.

Example 36

Production of EnAd Viruses Expressing shRNAs

The plasmid pEnAd2.4 (SEQ ID NO: 64) is used to generate the plasmids pNG-sh01 and pNG-sh02 by direct insertion of cassettes encoding respectively either a shRNA to the protein GAPDH, or a control shRNA that does not share a sequence with any human gene. The pNG-sh01 cassette contains a U6 human RNA polymerase III promoter, and a shRNA sequence consisting of: a 29 nt antisense sequence, a loop sequence, a 29 nt sense sequence and a 3' TTTTTT sequence. Schematics of the inserted transgene cassettes are shown in FIG. 54. Construction of plasmids is confirmed by DNA sequencing.
Virus Production and Characterisation The viruses NG-sh01 (SEQ ID NO: 66) and NG-sh02 are amplified and purified according to methods used to purify the NG-135 virus detailed in Example 8. GAPDH expression in human cell lines is decreased in cells treated with NG-sh01 but not cells treated with NG-sh02.

SEQUENCE LISTING (90 sequences)

SEQ ID NO: 1 - DNA, 35373 bp, Artificial Sequence
  NG-77 virus genome sequence
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgctgctaatcctttctctcttcaggccaccatgggatggagctgtatcatcctcttcttggtagcaacagctacaggtgtccactccgaggttcagctggtggagtctggcggtggcctggtgcagccagggggctcactccgtttgtcctgtgcagcttctggctataccttcaccaactatggtatgaactgggtccgtcaggccccgggtaagggcctggaatgggttggatggattaacacctataccggtgaaccgacctatgctgcggatttcaaacgtcgttttactttttctctggacacctccaagagcacagcttacctgcagatgaacagcctgcgcgctgaggacactgccgtctattactgtgcaaagtacccgcactattatgggagcagccactggtatttcgacgtctggggtcaaggaaccctggtcaccgtctcctcggcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtcgacaagaaagttgagcccaaatcttgtgacaaaactcacacatgcccaccgtgcccagcacctgagctcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggtaaatgatctagactcgaggtttctagaagttgtctcctcctgcactgactgactgacctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctcccctcaagcgtattcaacaaggggctgaaggatgcccagaaggtaccccattgtatgggatctgatctggggcctcggtgcacatgcttttcatgtgtttagtcgaggttaaaaaacgtctaggccccccgaaccacggggacgtggttttcctttgaaaaacacgatgataataacatgggatggagctgtatcatcctcttcttggtagcaacagctacaggtgtccactccgatatccagatgacccagtccccgagctccctgtccgcctctgtgggcgatagggtcaccatcacctgcagcgcaagtcaggatattagcaactatttaaactggtatcaacagaaaccaggaaaagctccgaaagtcctgatttacttcacctcctctctccactctggagtcccttctcgcttctctggatccggttctgggacggatttcactctgaccatcagcagtctgcagccagaagacttcgcaacttattactgtcaacagtatagcaccgtgccgtggacgtttggacagggtaccaaggtggagatcaaacgaactgtggctgcaccatctgtcttcatcttcccgccatctgatgagcagttgaaatctggaactgcttctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 2 - DNA, 35355 bp, Artificial Sequence
  NG-135 virus genome sequence
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatgggatggagctgtatcatcctcttcttggtagcaacagctacaggtgtccactccgaggttcagctggtggagtctggcggtggcctggtgcagccagggggctcactccgtttgtcctgtgcagcttctggctataccttcaccaactatggtatgaactgggtccgtcaggccccgggtaagggcctggaatgggttggatggattaacacctataccggtgaaccgacctatgctgcggatttcaaacgtcgttttactttttctctggacacctccaagagcacagcttacctgcagatgaacagcctgcgcgctgaggacactgccgtctattactgtgcaaagtacccgcactattatgggagcagccactggtatttcgacgtctggggtcaaggaaccctggtcaccgtctcctcggcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtcgacaagaaagttgagcccaaatcttgtgacaaaactcacacatgcccaccgtgcccagcacctgagctcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggtaaatgatctagactcgaggtttctagaagttgtctcctcctgcactgactgactgacctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctcccctcaagcgtattcaacaaggggctgaaggatgcccagaaggtaccccattgtatgggatctgatctggggcctcggtgcacatgcttttcatgtgtttagtcgaggttaaaaaacgtctaggccccccgaaccacggggacgtggttttcctttgaaaaacacgatgataataacatggactggacctggcgcgtgttttgcctgctcgccgtggctcctggggcccacagcgatatccagatgacccagtccccgagctccctgtccgcctctgtgggcgatagggtcaccatcacctgcagcgcaagtcaggatattagcaactatttaaactggtatcaacagaaaccaggaaaagctccgaaagtcctgatttacttcacctcctctctccactctggagtcccttctcgcttctctggatccggttctgggacggatttcactctgaccatcagcagtctgcagccagaagacttcgcaacttattactgtcaacagtatagcaccgtgccgtggacgtttggacagggtaccaaggtggagatcaaacgaactgtggctgcaccatctgtcttcatcttcccgccatctgatgagcagttgaaatctggaactgcttctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 3 - DNA, 34493 bp, Artificial Sequence
  A virus genome sequence consisting of a transgene cassette that encodes an anti-VEGF full length antibody inserted in the region BY. The transgene cassette contains a SSA, ab heavy chain sequence with 5' leader, a SSA,and ab light chain sequence with
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggccaccatgggatggagctgtatcatcctcttcttggtagcaacagctacaggtgtccactccgaggttcagctggtggagtctggcggtggcctggtgcagccagggggctcactccgtttgtcctgtgcagcttctggctataccttcaccaactatggtatgaactgggtccgtcaggccccgggtaagggcctggaatgggttggatggattaacacctataccggtgaaccgacctatgctgcggatttcaaacgtcgttttactttttctctggacacctccaagagcacagcttacctgcagatgaacagcctgcgcgctgaggacactgccgtctattactgtgcaaagtacccgcactattatgggagcagccactggtatttcgacgtctggggtcaaggaaccctggtcaccgtctcctcggcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtcgacaagaaagttgagcccaaatcttgtgacaaaactcacacatgcccaccgtgcccagcacctgagctcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggtaaatgatctagactcgagcaggcgagcatggactggacctggcgcgtgttttgcctgctcgccgtggctcctggggcccacagcgatatccagatgacccagtccccgagctccctgtccgcctctgtgggcgatagggtcaccatcacctgcagcgcaagtcaggatattagcaactatttaaactggtatcaacagaaaccaggaaaagctccgaaagtcctgatttacttcacctcctctctccactctggagtcccttctcgcttctctggatccggttctgggacggatttcactctgaccatcagcagtctgcagccagaagacttcgcaacttattactgtcaacagtatagcaccgtgccgtggacgtttggacagggtaccaaggtggagatcaaacgaactgtggctgcaccatctgtcttcatcttcccgccatctgatgagcagttgaaatctggaactgcttctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaacctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 4 - DNA, 34754 bp, Artificial Sequence
  A virus genome sequence consisting of a transgene cassette that encodes an anti-VEGF full length antibody inserted in the region BY.
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggccaccatgggatggagctgtatcatcctcttcttggtagcaacagctacaggtgtccactccgaggttcagctggtggagtctggcggtggcctggtgcagccagggggctcactccgtttgtcctgtgcagcttctggctataccttcaccaactatggtatgaactgggtccgtcaggccccgggtaagggcctggaatgggttggatggattaacacctataccggtgaaccgacctatgctgcggatttcaaacgtcgttttactttttctctggacacctccaagagcacagcttacctgcagatgaacagcctgcgcgctgaggacactgccgtctattactgtgcaaagtacccgcactattatgggagcagccactggtatttcgacgtctggggtcaaggaaccctggtcaccgtctcctcggcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtcgacaagaaagttgagcccaaatcttgtgacaaaactcacacatgcccaccgtgcccagcacctgagctcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggtaaatgatctagactcgagcaggccgacatggactggacctggcgcgtgttttgcctgctcgccgtggctcctggggcccacagcgatatccagatgacccagtccccgagctccctgtccgcctctgtgggcgatagggtcaccatcacctgcagcgcaagtcaggatattagcaactatttaaactggtatcaacagaaaccaggaaaagctccgaaagtcctgatttacttcacctcctctctccactctggagtcccttctcgcttctctggatccggttctgggacggatttcactctgaccatcagcagtctgcagccagaagacttcgcaacttattactgtcaacagtatagcaccgtgccgtggacgtttggacagggtaccaaggtggagatcaaacgaactgtggctgcaccatctgtcttcatcttcccgccatctgatgagcagttgaaatctggaactgcttctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 5 - DNA, 33442 bp, Artificial Sequence
  NG-74 virus genome sequence
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgctgctaatcctttctctcttcaggccaccatgggatggagctgtatcatcctcttcttggtagcaacagctacaggtgtccactccgaggttcagctggtggagtctggcggtggcctggtgcagccagggggctcactccgtttgtcctgtgcagcttctggctataccttcaccaactatggtatgaactgggtccgtcaggccccgggtaagggcctggaatgggttggatggattaacacctataccggtgaaccgacctatgctgcggatttcaaacgtcgttttactttttctctggacacctccaagagcacagcttacctgcagatgaacagcctgcgcgctgaggacactgccgtctattactgtgcaaagtacccgcactattatgggagcagccactggtatttcgacgtctggggtcaaggaaccctggtcaccgtctcctcgggtggcggtggctcgggcggtggtggatctggtggcggcggatctgatatccagatgacccagtccccgagctccctgtccgcctctgtgggcgatagggtcaccatcacctgcagcgcaagtcaggatattagcaactatttaaactggtatcaacagaaaccaggaaaagctccgaaagtcctgatttacttcacctcctctctccactctggagtcccttctcgcttctctggatccggttctgggacggatttcactctgaccatcagcagtctgcagccagaagacttcgcaacttattactgtcaacagtatagcaccgtgccgtggacgtttggacagggtaccaaggtggagatcaaacgataagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 6 - DNA, 33460 bp, Artificial Sequence
  NG-78 virus genome sequence
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgctgctaatcctttctctcttcaggccaccatgggatggagctgtatcatcctcttcttggtagcaacagctacaggtgtccactccgaggttcagctggtggagtctggcggtggcctggtgcagccagggggctcactccgtttgtcctgtgcagcttctggctataccttcaccaactatggtatgaactgggtccgtcaggccccgggtaagggcctggaatgggttggatggattaacacctataccggtgaaccgacctatgctgcggatttcaaacgtcgttttactttttctctggacacctccaagagcacagcttacctgcagatgaacagcctgcgcgctgaggacactgccgtctattactgtgcaaagtacccgcactattatgggagcagccactggtatttcgacgtctggggtcaaggaaccctggtcaccgtctcctcgggtggcggtggctcgggcggtggtggatctggtggcggcggatctgatatccagatgacccagtccccgagctccctgtccgcctctgtgggcgatagggtcaccatcacctgcagcgcaagtcaggatattagcaactatttaaactggtatcaacagaaaccaggaaaagctccgaaagtcctgatttacttcacctcctctctccactctggagtcccttctcgcttctctggatccggttctgggacggatttcactctgaccatcagcagtctgcagccagaagacttcgcaacttattactgtcaacagtatagcaccgtgccgtggacgtttggacagggtaccaaggtggagatcaaacgacatcatcaccaccaccattaagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 7 - DNA, 34117 bp, Artificial Sequence
  NG-76 virus genome sequence
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgcggctcccgccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcagatctttgtcgatcctaccatccactcgacacacccgccagcggccgctgccaagcttccgagctctcgaattcaaaggaggtacccaccatgggatggagctgtatcatcctcttcttggtagcaacagctacaggtgtccactccgaggttcagctggtggagtctggcggtggcctggtgcagccagggggctcactccgtttgtcctgtgcagcttctggctataccttcaccaactatggtatgaactgggtccgtcaggccccgggtaagggcctggaatgggttggatggattaacacctataccggtgaaccgacctatgctgcggatttcaaacgtcgttttactttttctctggacacctccaagagcacagcttacctgcagatgaacagcctgcgcgctgaggacactgccgtctattactgtgcaaagtacccgcactattatgggagcagccactggtatttcgacgtctggggtcaaggaaccctggtcaccgtctcctcgggtggcggtggctcgggcggtggtggatctggtggcggcggatctgatatccagatgacccagtccccgagctccctgtccgcctctgtgggcgatagggtcaccatcacctgcagcgcaagtcaggatattagcaactatttaaactggtatcaacagaaaccaggaaaagctccgaaagtcctgatttacttcacctcctctctccactctggagtcccttctcgcttctctggatccggttctgggacggatttcactctgaccatcagcagtctgcagccagaagacttcgcaacttattactgtcaacagtatagcaccgtgccgtggacgtttggacagggtaccaaggtggagatcaaacgacatcatcaccaccaccattaagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 8 - DNA, 34099 bp, Artificial Sequence
  NG-73 virus genome sequence
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgcggctcccgccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcagatctttgtcgatcctaccatccactcgacacacccgccagcggccgctgccaagcttccgagctctcgaattcaaaggaggtacccaccatgggatggagctgtatcatcctcttcttggtagcaacagctacaggtgtccactccgaggttcagctggtggagtctggcggtggcctggtgcagccagggggctcactccgtttgtcctgtgcagcttctggctataccttcaccaactatggtatgaactgggtccgtcaggccccgggtaagggcctggaatgggttggatggattaacacctataccggtgaaccgacctatgctgcggatttcaaacgtcgttttactttttctctggacacctccaagagcacagcttacctgcagatgaacagcctgcgcgctgaggacactgccgtctattactgtgcaaagtacccgcactattatgggagcagccactggtatttcgacgtctggggtcaaggaaccctggtcaccgtctcctcgggtggcggtggctcgggcggtggtggatctggtggcggcggatctgatatccagatgacccagtccccgagctccctgtccgcctctgtgggcgatagggtcaccatcacctgcagcgcaagtcaggatattagcaactatttaaactggtatcaacagaaaccaggaaaagctccgaaagtcctgatttacttcacctcctctctccactctggagtcccttctcgcttctctggatccggttctgggacggatttcactctgaccatcagcagtctgcagccagaagacttcgcaacttattactgtcaacagtatagcaccgtgccgtggacgtttggacagggtaccaaggtggagatcaaacgataagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 9 - DNA, 36030 bp, Artificial Sequence
  NG-134 virus genome sequence
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgcggctcccgccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcagatctttgtcgatcctaccatccactcgacacacccgccagcggccgctgccaagcttccgagctctcgaattcaaaggaggtacccaccatgggatggagctgtatcatcctcttcttggtagcaacagctacaggtgtccactccgaggttcagctggtggagtctggcggtggcctggtgcagccagggggctcactccgtttgtcctgtgcagcttctggctataccttcaccaactatggtatgaactgggtccgtcaggccccgggtaagggcctggaatgggttggatggattaacacctataccggtgaaccgacctatgctgcggatttcaaacgtcgttttactttttctctggacacctccaagagcacagcttacctgcagatgaacagcctgcgcgctgaggacactgccgtctattactgtgcaaagtacccgcactattatgggagcagccactggtatttcgacgtctggggtcaaggaaccctggtcaccgtctcctcggcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtcgacaagaaagttgagcccaaatcttgtgacaaaactcacacatgcccaccgtgcccagcacctgagctcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggtaaatgatctagactcgaggtttctagaagttgtctcctcctgcactgactgactgacctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctcccctcaagcgtattcaacaaggggctgaaggatgcccagaaggtaccccattgtatgggatctgatctggggcctcggtgcacatgcttttcatgtgtttagtcgaggttaaaaaacgtctaggccccccgaaccacggggacgtggttttcctttgaaaaacacgatgataataacatggactggacctggcgcgtgttttgcctgctcgccgtggctcctggggcccacagcgatatccagatgacccagtccccgagctccctgtccgcctctgtgggcgatagggtcaccatcacctgcagcgcaagtcaggatattagcaactatttaaactggtatcaacagaaaccaggaaaagctccgaaagtcctgatttacttcacctcctctctccactctggagtcccttctcgcttctctggatccggttctgggacggatttcactctgaccatcagcagtctgcagccagaagacttcgcaacttattactgtcaacagtatagcaccgtgccgtggacgtttggacagggtaccaaggtggagatcaaacgaactgtggctgcaccatctgtcttcatcttcccgccatctgatgagcagttgaaatctggaactgcttctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 10 - DNA, 201 bp, Artificial Sequence
  BX DNA sequence corresponding to and including bp 28166-28366 of the EnAd genome
aaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccag

SEQ ID NO: 11 - DNA, 35 bp, Artificial Sequence
  BY DNA sequence corresponding to and including bp 29345-29379 of the EnAd genome
caaataaagtttaacttgtttatttgaaaatcaat

SEQ ID NO: 12 - DNA, 32326 bp, Artificial Sequence
  EnAd genome
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 13 - DNA, 572 bp, Artificial Sequence
  CMV exogenous promoter
agtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgt

SEQ ID NO: 14 - DNA, 505 bp, Artificial Sequence
  PGK exogenous promoter
ctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctacccctcccctagtcaggaagttcccccccgccccgcagctcgcgtcatgcaggacgtgacaaatggaagtagcacgtctcactagtctcgtgcaaatggacagcaccgctgagcaatggaagcgggtaggcccttggggcagcggccaatagcagctttgctccttcgctttctgggctcagaggctgggaaggggtgggtccgggggcgggctcaggggcgggctcaggggcggggcgggcgcccgaaggtcctccggaggcccggcattccgcacgcttcaaaagcgcacgtctgccgcgctgttctcttcttcctcatctccgggcctttcg

SEQ ID NO: 15 - DNA, 367 bp, Artificial Sequence
  CBA exogenous promoter
gtcgaggtgagccccacgttctgcttcactctccccatctcccccccctccccacccccaattttgtatttatttattttttaattattttatgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacag

SEQ ID NO: 16 - DNA, 4 bp, Artificial Sequence
  Short splice acceptor (SSA)
cagg

SEQ ID NO: 17 - DNA, 16 bp, Artificial Sequence
  splice acceptor (SA)
cctttctctcttcagg

SEQ ID NO: 18 - DNA, 23 bp, Artificial Sequence
  branched splice acceptor (bSA)
tgctaatcctttctctcttcagg

SEQ ID NO: 19 - DNA, 551 bp, Artificial Sequence
  Internal Ribosome Entry sequence (IRES)
cgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctcccctcaagcgtattcaacaaggggctgaaggatgcccagaaggtaccccattgtatgggatctgatctggggcctcggtgcacatgcttttcatgtgtttagtcgaggttaaaaaacgtctaggccccccgaaccacggggacgtggttttcctttgaaaaacacgatgataata

SEQ ID NO: 20 - DNA, 192 bp, Artificial Sequence
  polyadenylation sequence
cagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggtttttt

SEQ ID NO: 21 - protein, 19 aa, Artificial Sequence
  Leader sequence
MGWSCIILFLVATATGVHS

SEQ ID NO: 22 - protein, 19 aa, Artificial Sequence
  Leader sequence
MDWTWRVFCLLAVAPGAHS

SEQ ID NO: 23 - protein, 6 aa, Artificial Sequence
  Histidine tag
HHHHHH

SEQ ID NO: 24 - protein, 14 aa, Artificial Sequence
  V5 tag
GKPIPNPLLGLDST

SEQ ID NO: 25 - protein, 22 aa, Artificial Sequence
  P2A peptide
GSGATNFSLLKQAGDVEENPGP

SEQ ID NO: 26 - protein, 21 aa, Artificial Sequence
  F2A peptide
GSGEGRGSLLTCGDVEENPGP

SEQ ID NO: 27 - protein, 23 aa, Artificial Sequence
  E2A peptide
GSGQCTNYALLKLAGDVESNPGP

SEQ ID NO: 28 - protein, 25 aa, Artificial Sequence
  T2A peptide
GSGVKQTLNFDLLKLAGDVESNPGP

SEQ ID NO: 29 - protein, 123 aa, Artificial Sequence [sequence omitted]

SEQ ID NO: 30 - protein, 118 aa, Artificial Sequence
  anti-PD-L1 antibody VH chain amino acid sequence
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSA

SEQ ID NO: 31 - protein, 108 aa, Artificial Sequence
  anti-VEGF ab VL chain amino acid sequence
DIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKR

SEQ ID NO: 32 - protein, 108 aa, Artificial Sequence
  anti-PD-L1 antibody VL chain amino acid sequence
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKR

SEQ ID NO: 33 - protein, 330 aa, Artificial Sequence
  human IgG1 constant heavy chain amino acid sequence
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 34 - protein, 330 aa, Artificial Sequence
  human IgG1 modified constant heavy chain amino acid sequence
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVAVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 35 - protein, 105 aa, Artificial Sequence [sequence omitted]

SEQ ID NO: 36 - protein, 265 aa, Artificial Sequence
  anti-VEGF ScFv amino acid sequence
MGWSCIILFLVATATGVHSEVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSGGGGSGGGGSGGGGSDIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKR

SEQ ID NO: 37 - protein, 260 aa, Artificial Sequence
  anti-PD-L1 ScFv amino acid sequence
MGWSCIILFLVATATGVHSEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSAGGGGSGGGGSGGGGSDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKR

SEQ ID NO: 38 - protein, 239 aa, Artificial Sequence
  Green fluorescent protein amino acid sequence
MVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 39 - protein, 550 aa, Artificial Sequence
  Luciferase amino acid sequence
MEDAKNIKKGPAPFYPLEDGTAGEQLHKAMKRYALVPGTIAFTDAHIEVDITYAEYFEMSVRLAEAMKRYGLNTNHRIVVCSENSLQFFMPVLGALFIGVAVAPANDIYNERELLNSMGISQPTVVFVSKKGLQKILNVQKKLPIIQKIIIMDSKTDYQGFQSMYTFVTSHLPPGFNEYDFVPESFDRDKTIALIMNSSGSTGLPKGVALPHRTACVRFSHARDPIFGNQIIPDTAILSVVPFHHGFGMFTTLGYLICGFRVVLMYRFEEELFLRSLQDYKIQSALLVPTLFSFFAKSTLIDKYDLSNLHEIASGGAPLSKEVGEAVAKRFHLPGIRQGYGLTETTSAILITPEGDDKPGAVGKVVPFFEAKVVDLDTGKTLGVNQRGELCVRGPMIMSGYVNNPEATNALIDKDGWLHSGDIAYWDEDEHFFIVDRLKSLIKYKGYQVAPAELESILLQHPNIFDAGVAGLPDDDAGELPAAVVVLEHGKTMTEKEIVDYVASQVTTAKKLRGGVVFVDEVPKGLTGKLDARKIREILIKAKKGGKIAV

SEQ ID NO: 40 - protein, 233 aa, Artificial Sequence
  Human Tumour necrosis factor alpha amino acid sequence
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 41 - protein, 166 aa, Artificial Sequence
  Human Interferon gamma amino acid sequence
MKYTSYILAFQLCIVLGSLGCYCQDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRGRRASQ

SEQ ID NO: 42 - protein, 188 aa, Artificial Sequence
  Human Interferon alpha amino acid sequence
MALTFALLVALLVLSCKSSCSVGCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 43 - protein, 180 aa, Artificial Sequence
  human cancer/testis angtigen 1 (NY-ESO-1) amino acid sequence
MQAEGRGTGGSTGDADGPGGPGIPDGPGGNAGGPGEAGATGGRGPRGAGAARASGPGGGAPRGPHGGAASGLNGCCRCGARGPESRLLEFYLAMPFATPMEAELARRSLAQDAPPLPVPGVLLKEFTVSGNILTIRLTAADHRQLQLSISSCLQQLSLLMWITQCFLPVFLAQPPSGQRR

SEQ ID NO: 44 - protein, 1255 aa, Artificial Sequence
  human MUC-1 amino acid sequence
MTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDNRPALGSTAPPVHNVTSASGSASGSASTLVHNGTSARATTTPASKSTPFSIPSHHSDTPTTLASHSTKTDASSTHHSSVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 45 - DNA, 9 bp, Artificial Sequence
  A Kozak sequence
gccaccatg

SEQ ID NO: 46 - DNA, 35334 bp, Artificial Sequence
  NG-177 virus genome sequence consisting of a transgene cassette encoding an anti-PD-L1 full length antibody inserted into the region BY.
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaacctttaaaggttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatgggatggagctgcattatcctgtttctggttgctactgccactggagtgcatagcgaggtacagcttgtcgagtctggaggtgggctggtacaaccaggcggatccctcagactgtcttgtgccgcatctggcttcacgttcagcgatagttggatacactgggtgaggcaggcaccagggaaaggtctggagtgggtggcttggataagcccatatggtggctccacatattacgccgactcagtgaagggtcgcttcaccatttctgctgatacgtcaaagaacacagcctatctccagatgaactcccttcgtgccgaggataccgctgtctactattgtgcccggagacattggcctggcgggttcgactactggggacaggggactctcgtcactgtttctgcagcgtctactaaagggcccagcgtgtttcctcttgctccctccagtaagtcaactagtggcggcaccgctgctttgggctgcctggtcaaggactattttccagagcctgtaaccgtgagctggaatagtggagcattgacctcaggagtgcacacatttcccgcagtgctgcagtcaagcggactgtacagcctttccagtgtggtgaccgttccttcctcaagtctgggcactcaaacctacatctgcaacgtgaaccacaaacccagcaataccaaagtcgacaagaaggttgagccgaagagctgtgacaaaacgcacacatgccctccatgtcccgccccagaactgctcggtggaccgtccgtgttcctgtttcctccgaagcccaaggacacactgatgatcagtcgcaccccagaagtcacctgtgtggtggtggcggtaagccacgaagatcccgaggtcaagttcaattggtatgtcgatggggttgaggtccacaatgccaagactaagccaagggaggaacagtatgccagcacataccgagtcgtgtctgtgctgaccgttctgcatcaggactggctcaacgggaaagagtacaagtgcaaagtgtccaacaaggcacttcctgcccctatcgagaaaaccatcagcaaggcgaaaggtcagcccagagaaccacaagtctacacactgccaccctctcgggacgaactcacaaagaatcaggtgtcactgacatgcttggttaaaggcttttaccccagcgatattgccgtggaatgggaatccaatgggcaacctgagaacaactacaagactacacctcccgtattggatagcgatggaagcttcttcctgtactctaagttgacggttgacaaatccaggtggcagcagggcaatgtgttttcttgctccgtaatgcatgaagctctgcataatcactatacccagaaatccctctcactgagtccgggcaaatgactcgaggtttctagaagttgtctcctcctgcactgactgactgacctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctcccctcaagcgtattcaacaaggggctgaaggatgcccagaaggtaccccattgtatgggatctgatctggggcctcggtgcacatgcttttcatgtgtttagtcgaggttaaaaaacgtctaggccccccgaaccacggggacgtggttttcctttgaaaaacacgatgataataacatggactggacctggcgcgtgttttgcctgctcgccgtggctcctggggcccacagcgatatccaaatgactcagtctccctcttcactgtctgcaagcgttggcgatagggtgacaattacctgtagagcgagtcaggacgtttcaaccgctgtagcctggtaccagcagaaaccgggaaaagcccctaagctgctcatttactccgcttcctttctctattccggagtgcctagccgatttagtggctctggttcagggactgacttcacactgaccatatccagtctgcaaccagaggatttcgcgacgtactactgtcagcagtatctgtatcaccccgctacatttgggcaagggacaaaagtggagatcaaacggactgtagccgcacccagcgtgttcatctttccaccctctgatgagcagcttaagagcggtacggcatctgtcgtgtgcttgctgaacaacttctatcctcgtgaagccaaagtccagtggaaggtggacaatgccttgcagtcaggcaactcacaggaaagcgtcactgaacaggacagcaaggatagtacctacagcctgtccagcacactgactctctccaaagccgactatgagaagcacaaggtttacgcttgcgaagtgacccatcaaggccttagcagtccagtcaccaagtccttcaatcgcggagagtgctgagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 47 - DNA, 5288 bp, Artificial Sequence
  DNA sequence corresponding to E2B region of the EnAd genome (bp 10355-5068)
ctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcat

SEQ ID NO: 48 - DNA, 33432 bp, Artificial Sequence
  NG-167 virus genome sequence consisting of a transgene cassette that encodes an anti-VEGF ScFv with a C-terminal His6 tag, inserted in the region BY.
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggccaccatgggatggagctgtatcatcctcttcttggtagcaacagctacaggtgtccactccgaagtgcaactggtggagtctggcggaggtctggtgcagcctggaggctctctcagactgtcatgcgctgcaagcggttttaccatctctgactactggatccattgggtgcgtcaggctcctggaaaaggccttgagtgggttgcgggtataactccagcaggcgggtacacctactacgccgatagcgttaaaggccgctttaccattagcgcggacaccagcaagaataccgcctatctgcagatgaactcactgagagcggaggatacagcagtgtactattgcgcaagattcgtgttctttctgccatacgctatggactattggggccaagggacactggttacagtatcctcgggtggcggtggctcgggcggtggtggatctggtggcggcggatctgacatccagatgacccagagcccatcaagtctgtccgccagcgttggcgatcgagtcaccattacttgtagggcttctcaggacgtgtctacagctgttgcttggtatcagcagaaaccagggaaagcacccaaacttctgatctactcagcttccttcctgtactcaggagttcctagtcggtttagtggcagcggcagtggcacagacttcacgctcaccattagcagtctccagcctgaggattttgccacttactactgtcagcaagggtatggaaatcccttcacattcgggcaaggaaccaaagtcgagattaagaggcatcatcaccaccaccattaagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 49 - DNA, 33765 bp, Artificial Sequence
  NG-95 virus genome sequence consisting of a transgene cassette that encodes the cytokine, IFN?, inserted in the region BY.
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgcggctcccgccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcagatctttgtcgatcctaccatccactcgacacacccgccagcggccgcccaccatgaaatatacaagttatatcttggcttttcagctctgcatcgttttgggttctcttggctgttactgccaggacccatatgtaaaagaagcagaaaaccttaagaaatattttaatgcaggtcattcagatgtagcggataatggaactcttttcttaggcattttgaagaattggaaagaggagagtgacagaaaaataatgcagagccaaattgtctccttttacttcaaactttttaaaaactttaaagatgaccagagcatccaaaagagtgtggagaccatcaaggaagacatgaatgtcaagtttttcaatagcaacaaaaagaaacgagatgacttcgaaaagctgactaattattcggtaactgacttgaatgtccaacgcaaagcaatacatgaactcatccaagtgatggctgaactgtcgccagcagctaaaacagggaagcgaaaaaggagtcagatgctgtttcgaggtcgaagagcatcccagtaagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 50 - DNA, 33868 bp, Artificial Sequence
  NG-97 virus genome sequence consisting of a transgene cassette that encodes the cytokine, IFN?, inserted in the region BY.
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgcggctcccgccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcagatctttgtcgatcctaccatccactcgacacacccgccagcggccgctgccaagcttccgagctctcgaattcaaaggaggtacccaccatggccttgacctttgctttactggtggccctcctggtgctcagctgcaagtcaagctgctctgtgggctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaatgagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 51 - DNA, 33132 bp, Artificial Sequence
  NG-92 virus genome sequence consisting of a transgene cassette that encodes the cytokine, IFN?, inserted in the region BY.
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgctgctaatcctttctctcttcaggccaccatgaaatatacaagttatatcttggcttttcagctctgcatcgttttgggttctcttggctgttactgccaggacccatatgtaaaagaagcagaaaaccttaagaaatattttaatgcaggtcattcagatgtagcggataatggaactcttttcttaggcattttgaagaattggaaagaggagagtgacagaaaaataatgcagagccaaattgtctccttttacttcaaactttttaaaaactttaaagatgaccagagcatccaaaagagtgtggagaccatcaaggaagacatgaatgtcaagtttttcaatagcaacaaaaagaaacgagatgacttcgaaaagctgactaattattcggtaactgacttgaatgtccaacgcaaagcaatacatgaactcatccaagtgatggctgaactgtcgccagcagctaaaacagggaagcgaaaaaggagtcagatgctgtttcgaggtcgaagagcatcccagtaagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 52 - DNA, 33199 bp, Artificial Sequence
  NG-96 virus genome sequence consisting of a transgene cassette that encodes the cytokine, IFN?, inserted in the region BY.
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaacctttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgctgctaatcctttctctcttcaggccaccatggccttgacctttgctttactggtggccctcctggtgctcagctgcaagtcaagctgctctgtgggctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaatgagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 53 - DNA, 33314 bp, Artificial Sequence
  NG-139 virus genome sequence consisting of a transgene cassette that encodes the cytokine, TNF?, inserted in the region BY.
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggccgccatgagcactgaaagcatgatccgggacgtggagctggccgaggaggcgctccccaagaagacaggggggccccagggctccaggcggtgcttgttcctcagcctcttctccttcctgatcgtggcaggcgccaccacgctcttctgcctgctgcactttggagtgatcggcccccagagggaagagttccccagggacctctctctaatcagccctctggcccaggcagtcagatcatcttctcgaaccccgagtgacaagcctgtagcccatgttgtagcaaaccctcaagctgaggggcagctccagtggctgaaccgccgggccaatgccctcctggccaatggcgtggagctgagagataaccagctggtggtgccatcagagggcctgtacctcatctactcccaggtcctcttcaagggccaaggctgcccctccacccatgtgctcctcacccacaccatcagccgcatcgccgtctcctaccagaccaaggtcaacctcctctctgccatcaagagcccctgccagagggagaccccagagggggctgaggccaagccctggtatgagcccatctatctgggaggggtcttccagctggagaagggtgaccgactcagcgctgagatcaatcggcccgactatctcgactttgccgagtctgggcaggtctactttgggatcattgccctgtgagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 54 - DNA, 19 bp, Artificial Sequence
  Restriction site insert (BY)
gcgatcgctaccctgcagg

SEQ ID NO: 55 - DNA, 19 bp, Artificial Sequence
  Restriction site insert (BX)
gcggccgctatggccggcc

SEQ ID NO: 56 - DNA, 33770 bp, Artificial Sequence
  NG-220 virus genome sequence consisting of a transgene cassette that encodes the tumour associated antigen, NY-ESO-1, inserted in the region BY.
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgcggctcccgccagatctctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctacccctcccctagtcaggaagttcccccccgccccgcagctcgcgtcatgcaggacgtgacaaatggaagtagcacgtctcactagtctcgtgcaaatggacagcaccgctgagcaatggaagcgggtaggcccttggggcagcggccaatagcagctttgctccttcgctttctgggctcagaggctgggaaggggtgggtccgggggcgggctcaggggcgggctcaggggcggggcgggcgcccgaaggtcctccggaggcccggcattccgcacgcttcaaaagcgcacgtctgccgcgctgttctcttcttcctcatctccgggcctttcgagatctttgtcgatcctaccatccactcgacacacccgccagcggccgctgccaagcttccgagctctcgaattcaaaggaggtaccaccatgcaggccgaaggccggggcacagggggttcgacgggcgatgctgatggcccaggaggccctggcattcctgatggcccagggggcaatgctggcggcccaggagaggcgggtgccacgggcggcagaggtccccggggcgcaggggcagcaagggcctcggggccgggaggaggcgccccgcggggtccgcatggcggcgcggcttcagggctgaatggatgctgcagatgcggggccagggggccggagagccgcctgcttgagttctacctcgccatgcctttcgcgacacccatggaagcagagctggcccgcaggagcctggcccaggatgccccaccgcttcccgtgccaggggtgcttctgaaggagttcactgtgtccggcaacatactgactatccgactgactgctgcagaccaccgccaactgcagctctccatcagctcctgtctccagcagctttccctgttgatgtggatcacgcagtgctttctgcccgtgtttttggctcagcctccctcagggcagaggcgctaagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 57 - DNA, 33843 bp, Artificial Sequence
  NG-217 virus genome sequence consisting of a transgene cassette that encodes the tumour associated antigen, NY-ESO-1, inserted in the region BY
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgcggctcccgccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcagatctttgtcgatcctaccatccactcgacacacccgccagcggccgctgccaagcttccgagctctcgaattcaaaggaggtaccaccatgcaggccgaaggccggggcacagggggttcgacgggcgatgctgatggcccaggaggccctggcattcctgatggcccagggggcaatgctggcggcccaggagaggcgggtgccacgggcggcagaggtccccggggcgcaggggcagcaagggcctcggggccgggaggaggcgccccgcggggtccgcatggcggcgcggcttcagggctgaatggatgctgcagatgcggggccagggggccggagagccgcctgcttgagttctacctcgccatgcctttcgcgacacccatggaagcagagctggcccgcaggagcctggcccaggatgccccaccgcttcccgtgccaggggtgcttctgaaggagttcactgtgtccggcaacatactgactatccgactgactgctgcagaccaccgccaactgcagctctccatcagctcctgtctccagcagctttccctgttgatgtggatcacgcagtgctttctgcccgtgtttttggctcagcctccctcagggcagaggcgctaagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 58 - DNA, 35361 bp, Artificial Sequence
  NG-242 virus genome sequence consisting of a transgene cassette encoding an anti-CTLA-4 full length antibody inserted into the region BY.
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatgggatggagctgtatcatcctcttcttggtagcaacagctacaggtgtccactcccaggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagatccgaggggagctaccctttactactactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtcgacaagaaagttgagcccaaatcttgtgacaaaactcacacatgcccaccgtgcccagcacctgagctcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggtaaatgatctagactcgaggtttctagaagttgtctcctcctgcactgactgactgacctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctcccctcaagcgtattcaacaaggggctgaaggatgcccagaaggtaccccattgtatgggatctgatctggggcctcggtgcacatgcttttcatgtgtttagtcgaggttaaaaaacgtctaggccccccgaaccacggggacgtggttttcctttgaaaaacacgatgataataacatggactggacctggcgcgtgttttgcctgctcgccgtggctcctggggcccacagcgatatccagatgacccagtctccatcctccctgtctgcatctgtaggagacagagtcaccatcacttgccgggcaagtcagagcattaacagctatttagattggtatcagcagaaaccagggaaagcccctaaactcctgatctatgctgcatccagtttgcaaagtggggtcccatcaaggttcagtggcagtggatctgggacagatttcactctcaccatcagcagtctgcaacctgaagattttgcaacttactactgtcaacagtattacagtactccattcactttcggccctgggaccaaagtggaaatcaaacgaactgtggctgcaccatctgtcttcatcttcccgccatctgatgagcagttgaaatctggaactgcttctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 59 - DNA, 34807 bp, Artificial Sequence
  NG-165 virus genome sequence consisting of a transgene cassette encoding an anti-VEGF full length antibody inserted into the region BY.
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatgggatggagctgtatcatcctcttcttggtagcaacagctacaggtgtccactccgaggttcagctggtggagtctggcggtggcctggtgcagccagggggctcactccgtttgtcctgtgcagcttctggctataccttcaccaactatggtatgaactgggtccgtcaggccccgggtaagggcctggaatgggttggatggattaacacctataccggtgaaccgacctatgctgcggatttcaaacgtcgttttactttttctctggacacctccaagagcacagcttacctgcagatgaacagcctgcgcgctgaggacactgccgtctattactgtgcaaagtacccgcactattatgggagcagccactggtatttcgacgtctggggtcaaggaaccctggtcaccgtctcctcggcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtcgacaagaaagttgagcccaaatcttgtgacaaaactcacacatgcccaccgtgcccagcacctgagctcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggtaaaggaagcggagctactaacttcagcctgctgaagcaggctggagacgtggaggagaaccctggacctgactggacctggcgcgtgttttgcctgctcgccgtggctcctggggcccacagcgatatccagatgacccagtccccgagctccctgtccgcctctgtgggcgatagggtcaccatcacctgcagcgcaagtcaggatattagcaactatttaaactggtatcaacagaaaccaggaaaagctccgaaagtcctgatttacttcacctcctctctccactctggagtcccttctcgcttctctggatccggttctgggacggatttcactctgaccatcagcagtctgcagccagaagacttcgcaacttattactgtcaacagtatagcaccgtgccgtggacgtttggacagggtaccaaggtggagatcaaacgaactgtggctgcaccatctgtcttcatcttcccgccatctgatgagcagttgaaatctggaactgcttctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 60 - DNA, 34792 bp, Artificial Sequence
  NG-190 virus genome sequence consisting of a transgene cassette encoding an anti-PD-L1 full length antibody inserted into the region BY.
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatgggatggagctgcattatcctgtttctggttgctactgccactggagtgcatagcgaggtacagcttgtcgagtctggaggtgggctggtacaaccaggcggatccctcagactgtcttgtgccgcatctggcttcacgttcagcgatagttggatacactgggtgaggcaggcaccagggaaaggtctggagtgggtggcttggataagcccatatggtggctccacatattacgccgactcagtgaagggtcgcttcaccatttctgctgatacgtcaaagaacacagcctatctccagatgaactcccttcgtgccgaggataccgctgtctactattgtgcccggagacattggcctggcgggttcgactactggggacaggggactctcgtcactgtttctgcagcgtctactaaagggcccagcgtgtttcctcttgctccctccagtaagtcaactagtggcggcaccgctgctttgggctgcctggtcaaggactattttccagagcctgtaaccgtgagctggaatagtggagcattgacctcaggagtgcacacatttcccgcagtgctgcagtcaagcggactgtacagcctttccagtgtggtgaccgttccttcctcaagtctgggcactcaaacctacatctgcaacgtgaaccacaaacccagcaataccaaagtcgacaagaaggttgagccgaagagctgtgacaaaacgcacacatgccctccatgtcccgccccagaactgctcggtggaccgtccgtgttcctgtttcctccgaagcccaaggacacactgatgatcagtcgcaccccagaagtcacctgtgtggtggtggcggtaagccacgaagatcccgaggtcaagttcaattggtatgtcgatggggttgaggtccacaatgccaagactaagccaagggaggaacagtatgccagcacataccgagtcgtgtctgtgctgaccgttctgcatcaggactggctcaacgggaaagagtacaagtgcaaagtgtccaacaaggcacttcctgcccctatcgagaaaaccatcagcaaggcgaaaggtcagcccagagaaccacaagtctacacactgccaccctctcgggacgaactcacaaagaatcaggtgtcactgacatgcttggttaaaggcttttaccccagcgatattgccgtggaatgggaatccaatgggcaacctgagaacaactacaagactacacctcccgtattggatagcgatggaagcttcttcctgtactctaagttgacggttgacaaatccaggtggcagcagggcaatgtgttttcttgctccgtaatgcatgaagctctgcataatcactatacccagaaatccctctcactgagtccgggcaaaggaagcggagctactaacttcagcctgctgaagcaggctggagacgtggaggagaaccctggacctgactggacctggcgcgtgttttgcctgctcgccgtggctcctggggcccacagcgatatccaaatgactcagtctccctcttcactgtctgcaagcgttggcgatagggtgacaattacctgtagagcgagtcaggacgtttcaaccgctgtagcctggtaccagcagaaaccgggaaaagcccctaagctgctcatttactccgcttcctttctctattccggagtgcctagccgatttagtggctctggttcagggactgacttcacactgaccatatccagtctgcaaccagaggatttcgcgacgtactactgtcagcagtatctgtatcaccccgctacatttgggcaagggacaaaagtggagatcaaacggactgtagccgcacccagcgtgttcatctttccaccctctgatgagcagcttaagagcggtacggcatctgtcgtgtgcttgctgaacaacttctatcctcgtgaagccaaagtccagtggaaggtggacaatgccttgcagtcaggcaactcacaggaaagcgtcactgaacaggacagcaaggatagtacctacagcctgtccagcacactgactctctccaaagccgactatgagaagcacaaggtttacgcttgcgaagtgacccatcaaggccttagcagtccagtcaccaagtccttcaatcgcggagagtgctgagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 61 - DNA, 34792 bp, Artificial Sequence; identical to SEQ ID NO: 60
  NG-221 virus genome sequence consisting of the EnAd genome with a transgene cassette that encodes an anti-PD-L1 ScFv with a C-terminal His6 tag, inserted in the region BY.

SEQ ID NO: 62 - DNA, 35501 bp, Artificial Sequence
  NG-258 virus genome sequence consisting of a transgene cassette encoding an anti-VEGF full length antibody inserted into the region BY
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttactgcggccgctatggccggcctgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgcggctcccgccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcagatctttgtcgatcctaccatccactcgacacacccgccagcggccgctgccaagcttccgagctctcgaattcaaaggaggtacccaccatgggatggagctgtatcatcctcttcttggtagcaacagctacaggtgtccactccgaggttcagctggtggagtctggcggtggcctggtgcagccagggggctcactccgtttgtcctgtgcagcttctggctataccttcaccaactatggtatgaactgggtccgtcaggccccgggtaagggcctggaatgggttggatggattaacacctataccggtgaaccgacctatgctgcggatttcaaacgtcgttttactttttctctggacacctccaagagcacagcttacctgcagatgaacagcctgcgcgctgaggacactgccgtctattactgtgcaaagtacccgcactattatgggagcagccactggtatttcgacgtctggggtcaaggaaccctggtcaccgtctcctcggcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtcgacaagaaagttgagcccaaatcttgtgacaaaactcacacatgcccaccgtgcccagcacctgagctcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggtaaaggaagcggagctactaacttcagcctgctgaagcaggctggagacgtggaggagaaccctggacctgactggacctggcgcgtgttttgcctgctcgccgtggctcctggggcccacagcgatatccagatgacccagtccccgagctccctgtccgcctctgtgggcgatagggtcaccatcacctgcagcgcaagtcaggatattagcaactatttaaactggtatcaacagaaaccaggaaaagctccgaaagtcctgatttacttcacctcctctctccactctggagtcccttctcgcttctctggatccggttctgggacggatttcactctgaccatcagcagtctgcagccagaagacttcgcaacttattactgtcaacagtatagcaccgtgccgtggacgtttggacagggtaccaaggtggagatcaaacgaactgtggctgcaccatctgtcttcatcttcccgccatctgatgagcagttgaaatctggaactgcttctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 63 - DNA, 32364 bp, Artificial Sequence
  NG-185 virus genome sequence consisting of the EnAd genome with unique restriction sites inserted into the BX and BY regions.
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttactgcggccgctatggccggcctgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgctaccctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 64 - DNA, 35208 bp, Artificial Sequence
  pNG-33 (pColoAd2.4) DNA plasmid, consisting of a bacterial origin of replication (p15A), an antibiotic resistance gene (KanR) and the EnAd genome
ggcgcgcctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgctaccctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataggcgcgccctctcttaaggtagcatcgggatcgagtccctgagagaacatcctcaatcccgatctatccttagatccgaggaatatcgaaatcagttacgctagggataacagggtaatatagcatcccctcggattgctatctaccggctcgtcagctatgatctctcgatttcgatcaagaaatctcattggttaccttgggctatcgaaaccagtcaagtcagctacttggcgagatcgacttgtctgagtttcgactacgctcagaattgcgtcagcgcctatcgccaggtattactccaatcccgaatatccgagcctgagagaacatcctcaatcccgatctatccttagatccgaggaatatcgaaatcgtttaaatcttttcttgatggtaaatcattcgaatataagaatggagagacgaatggggaaacgacaaagatgacattctttggtccttctggtgaggttctcaagtttttggttaatcctgtcaacaacttatatcgtatggggctgacttcaggtgctacatttgaagagataaattgcactgaaatctagtaatattttatctgattaataagatgatcttcttgagatcgttttggtctgcgcgtaatctcttgctctgaaaacgaaaaaaccgccttgcagggcggtttttcgaaggttctctgagctaccaactctttgaaccgaggtaactggcttggcagagcgcagtcaccaaaacttgtcctttcagtttagccttaaccggcgcatgacttcaagactaactctgctaaatcaattaccagtggctgctgccagtggtgcttttgcatgtctttccgggttggactcaagacgatagttaccggataaggcgcagcggtcggactgaacggggggttcgtgcatacagtccagcttggagcgaactgcctacccggaactgagtgtcaggcgtggaatgagacaaacgcggccataacagcggaatgacaccggtaaaccgaaaggcaggaacaggagagcgcacgagggagccgccagggggaaacgcctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcgtaagccatttccgctcgccgcagtcgaacgaccgagcgtagcgagtcagtgagcgaggaagcggaatatatcctgtatcacatattctgctgacgcaccggtgcggccttttttctcctgccacatgaagcacttcactgacaccctcatcagtgccaacatagtaagccagtatacactccgctaatttaaacgtggtgtaccgagaacgatcctctcagtgcgatctcgacgatcagtggtattccgacatatcgttgcttggcagtcagccagtcgatcctagcttgggacccaggaagtccaatcgtcagatattgtactcagcctggtcacggcagcgtaccgatctcgtaactataacggtcctaaggtagcgaactagatattgatagtctgatcggtcaacgtataatcgagtcctagcttttgcaaacatctatcaagagacaggatcagcaggaggctttcgcatgattgaacaagatggattgcacgcaggttctccggcggcttgggtggagaggctattcggctatgactgggcacaacagacaatcggctgctctgatgccgccgtgttccggctgtcagcgcaggggcgtccggttctttttgtcaagaccgacctgtccggtgccctgaatgaactgcaagacgaggcagcgcggctatcgtggctggcgacgacgggcgttccttgcgcggctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgtctatgcccgacggcgaggatctcgtcgtgacccacggcgatgcctgcttgccgaatatcatggtggaaaatggccgcttttctggattcatcgactgtggccgtctgggtgtggcggaccgctatcaggacatagcgttggctacccgtgatattgctgaagagcttggcggcgaatgggctgaccgcttccttgtgctttacggtatcgccgcgcccgattcgcagcgcatcgccttctatcgccttcttgacgagttcttctgaccgattctaggtgcattggcgcagaaaaaaatgcctgatgcgacgctgcgcgtcttatactcccacatatgccagattcagcaacggatacggcttccccaacttgcccacttccatacgtgtcctccttaccagaaatttatccttaaggtccgtaactataacggtcctaaggtagcgaatcgacctagctctatcgaatctccctcgtttcgagcttacgcgaactagcctctggcgatagcatccgaggggcaggcatctatgtcgggtgcggagaaagaggtaatgtcaagttcgatctgattgcttggcataaagtccgatggttcgagtagactcagttcaacctctctcttaaggtagc

SEQ ID NO: 65 - DNA, 35231 bp, Artificial Sequence
  pNG-185 (pColoAd2.6) DNA plasmid, consisting of a bacterial origin of replication (p15A), an antibiotic resistance gene (KanR) and the EnAd genome sequence with inserted unique restriction sites in the BX and BY regions.
ggcgcgcctctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttactgcggccgctatggccggcctgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgctaccctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagatagaggcgcgccctctcttaaggtagcatcgggatcgagtccctgagagaacatcctcaatcccgatctatccttagatccgaggaatatcgaaatcagttacgctagggataacagggtaatatagcatcccctcggattgctatctaccggctcgtcagctatgatctctcgatttcgatcaagaaatctcattggttaccttgggctatcgaaaccagtcaagtcagctacttggcgagatcgacttgtctgagtttcgactacgctcagaattgcgtcagcgcctatcgccaggtattactccaatcccgaatatccgagcctgagagaacatcctcaatcccgatctatccttagatccgaggaatatcgaaatcgtttaaatcttttcttgatggtaaatcattcgaatataagaatggagagacgaatggggaaacgacaaagatgacattctttggtccttctggtgaggttctcaagtttttggttaatcctgtcaacaacttatatcgtatggggctgacttcaggtgctacatttgaagagataaattgcactgaaatctagtaatattttatctgattaataagatgatcttcttgagatcgttttggtctgcgcgtaatctcttgctctgaaaacgaaaaaaccgccttgcagggcggtttttcgaaggttctctgagctaccaactctttgaaccgaggtaactggcttggcagagcgcagtcaccaaaacttgtcctttcagtttagccttaaccggcgcatgacttcaagactaactctgctaaatcaattaccagtggctgctgccagtggtgcttttgcatgtctttccgggttggactcaagacgatagttaccggataaggcgcagcggtcggactgaacggggggttcgtgcatacagtccagcttggagcgaactgcctacccggaactgagtgtcaggcgtggaatgagacaaacgcggccataacagcggaatgacaccggtaaaccgaaaggcaggaacaggagagcgcacgagggagccgccagggggaaacgcctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcgtaagccatttccgctcgccgcagtcgaacgaccgagcgtagcgagtcagtgagcgaggaagcggaatatatcctgtatcacatattctgctgacgcaccggtgcggccttttttctcctgccacatgaagcacttcactgacaccctcatcagtgccaacatagtaagccagtatacactccgctaatttaaacgtggtgtaccgagaacgatcctctcagtgcgatctcgacgatcagtggtattccgacatatcgttgcttggcagtcagccagtcgatcctagcttgggacccaggaagtccaatcgtcagatattgtactcagcctggtcacggcagcgtaccgatctcgtaactataacggtcctaaggtagcgaactagatattgatagtctgatcggtcaacgtataatcgagtcctagcttttgcaaacatctatcaagagacaggatcagcaggaggctttcgcatgattgaacaagatggattgcacgcaggttctccggcggcttgggtggagaggctattcggctatgactgggcacaacagacaatcggctgctctgatgccgccgtgttccggctgtcagcgcaggggcgtccggttctttttgtcaagaccgacctgtccggtgccctgaatgaactgcaagacgaggcagcgcggctatcgtggctggcgacgacgggcgttccttgcgcggctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgtctatgcccgacggcgaggatctcgtcgtgacccacggcgatgcctgcttgccgaatatcatggtggaaaatggccgcttttctggattcatcgactgtggccgtctgggtgtggcggaccgctatcaggacatagcgttggctacccgtgatattgctgaagagcttggcggcgaatgggctgaccgcttccttgtgctttacggtatcgccgcgcccgattcgcagcgcatcgccttctatcgccttcttgacgagttcttctgaccgattctaggtgcattggcgcagaaaaaaatgcctgatgcgacgctgcgcgtcttatactcccacatatgccagattcagcaacggatacggcttccccaacttgcccacttccatacgtgtcctccttaccagaaatttatccttaaggtccgtaactataacggtcctaaggtagcgaatcgacctagctctatcgaatctccctcgtttcgagcttacgcgaactagcctctggcgatagcatccgaggggcaggcatctatgtcgggtgcggagaaagaggtaatgtcaagttcgatctgattgcttggcataaagtccgatggttcgagtagactcagttcaacctctctcttaaggtagc

SEQ ID NO: 66 - DNA, 32735 bp, Artificial Sequence
  pNG-sh01 virus genome sequence consisting of a transgene cassette encoding an shRNA to GAPDH inserted into the region BY
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgcccccagtggaaagacgcgcaggcaaaacgcaccacgtgacggagcgtgaccgcgcgccgagcccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacggtaaaccatgtagttgaggtcaatgaagggaagcttgccttcattgacctcaactacatggtttacttttttcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 67 - protein, 643 aa, Artificial Sequence
  Sodium Iodide symporter (NIS) amino acid sequence
MEAVETGERPTFGAWDYGVFALMLLVSTGIGLWVGLARGGQRSAEDFFTGGRRLAALPVGLSLSASFMSAVQVLGVPSEAYRYGLKFLWMCLGQLLNSVLTALLFMPVFYRLGLTSTYEYLEMRFSRAVRLCGTLQYIVATMLYTGIVIYAPALILNQVTGLDIWASLLSTGIICTFYTAVGGMKAVVWTDVFQVVVMLSGFWVVLARGVMLVGGPRQVLTLAQNHSRINLMDFNPDPRSRYTFWTFVVGGTLVWLSMYGVNQAQVQRYVACRTEKQAKLALLINQVGLFLIVSSAACCGIVMFVFYTDCDPLLLGRISAPDQYMPLLVLDIFEDLPGVPGLFLACAYSGTLSTASTSINAMAAVTVEDLIKPRLRSLAPRKLVIISKGLSLIYGSACLTVAALSSLLGGGVLQGSFTVMGVISGPLLGAFILGMFLPACNTPGVLAGLGAGLALSLWVALGATLYPPSEQTMRVLPSSAARCVALSVNASGLLDPALLPANDSSRAPSSGMDASRPALADSFYAISYLYYGALGTLTTVLCGALISCLTGPTKRSTLAPGLLWWDLARQTASVAPKEEVAILDDNLVKGPEELPTGNKKPPGFLPTNEDRLFFLGQKELEGAGSWTPCVGHDGGRDQQETNL

SEQ ID NO: 68 - DNA, 34558 bp, Artificial Sequence
  NG-280 virus genome sequence consisting of a transgene cassette encoding the sodium iodide symporter (NIS) inserted into the region BY
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatggaggccgtggagaccggggaacggcccaccttcggagcctgggactacggggtctttgccctcatgctcctggtgtccactggcatcgggctgtgggtcgggctggctcggggcgggcagcgcagcgctgaggacttcttcaccgggggccggcgcctggcggccctgcccgtgggcctgtcgctgtctgccagcttcatgtcggccgtgcaggtgctgggcgtgccgtcggaggcctatcgctatggcctcaagttcctctggatgtgcctgggccagcttctgaactcggtcctcaccgccctgctcttcatgcccgtcttctaccgcctgggcctcaccagcacctacgagtacctggagatgcgcttcagccgcgcagtgcggctctgcgggactttgcagtacattgtagccacgatgctgtacaccggcatcgtaatctacgcaccggccctcatcctgaaccaagtgaccgggctggacatctgggcgtcgctcctgtccaccggaattatctgcaccttctacacggctgtgggcggcatgaaggctgtggtctggactgatgtgttccaggtcgtggtgatgctaagtggcttctgggttgtcctggcacgcggtgtcatgcttgtgggcgggccccgccaggtgctcacgctggcccagaaccactcccggatcaacctcatggactttaaccctgacccgaggagccgctatacattctggacttttgtggtgggtggcacgttggtgtggctctccatgtatggcgtgaaccaggcgcaggtgcagcgctacgtggcttgccgcacagagaagcaggccaagctggccctgctcatcaaccaggtcggcctgttcctgatcgtgtccagcgctgcctgctgtggcatcgtcatgtttgtgttctacactgactgcgaccctctcctcctggggcgcatctctgccccagaccagtacatgcctctgctggtgctggacatcttcgaagatctgcctggagtccccgggcttttcctggcctgtgcttacagtggcaccctcagcacagcatccaccagcatcaatgctatggctgcagtcactgtagaagacctcatcaaacctcggctgcggagcctggcacccaggaaactcgtgattatctccaaggggctctcactcatctacggatcggcctgtctcaccgtggcagccctgtcctcactgctcggaggaggtgtccttcagggctccttcaccgtcatgggagtcatcagcggccccctgctgggagccttcatcttgggaatgttcctgccggcctgcaacacaccgggcgtcctcgcgggactaggcgcgggcttggcgctgtcgctgtgggtggccttgggcgccacgctgtacccacccagcgagcagaccatgagggtcctgccatcgtcggctgcccgctgcgtggctctctcagtcaacgcctctggcctcctggacccggctctcctccctgctaacgactccagcagggcccccagctcaggaatggacgccagccgacccgccttagctgacagcttctatgccatctcctatctctattacggtgccctgggcacgctgaccactgtgctgtgcggagccctcatcagctgcctgacaggccccaccaagcgcagcaccctggccccgggattgttgtggtgggacctcgcacggcagacagcatcagtggcccccaaggaagaagtggccatcctggatgacaacttggtcaagggtcctgaagaactccccactggaaacaagaagccccctggcttcctgcccaccaatgaggatcgtctgtttttcttggggcagaaggagctggagggggctggctcttggaccccctgtgttggacatgatggtggtcgagaccagcaggagacaaacctctgagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 69 - DNA, 34327 bp, Artificial Sequence
  NG-272 virus genome sequence comprising the EnAd genome with a transgene cassette encoding an anti-VEGF ScFv and an anti-PD-L1 ScFv inserted into the region BY.
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatgggatggagctgcatcatactgttcctggttgccacagctacaggggtacactccgaagtccagctcgttgaaagcggaggcgggttggtccaacctggcggctcacttcggctttcctgtgcagctagtgggttcaccttttccgatagctggatacactgggtgagacaggctccaggcaaaggcttggaatgggtcgcctggattagcccctatggaggcagcacctattacgccgattctgtgaaggggaggttcacaatctccgccgataccagtaagaacacagcctatctgcagatgaatagtctccgagccgaggacactgcagtgtactactgcgctaggcgtcattggccaggaggctttgactactggggtcaaggtaccctcgtgactgtgagtgcaggtggcggtggctcgggcggtggtggatctggtggcggcggatctgacatccagatgacacagagccctagctcactgtctgcgagcgtaggcgacagagtgaccatcacttgtcgggcttcccaggatgtgtccacagccgttgcatggtaccagcagaaacccgggaaagcaccaaagctgctgatctacagcgcttctttcctgtactcaggcgtgcctagccgctttagtgggtctggttctgggactgacttcaccctcacgatttcctcactgcaacccgaggattttgcgacctattactgccagcagtatctgtatcatccggccacttttgggcaaggcacgaaggtcgagattaagcgccatcatcaccaccaccacggaagcggagctactaacttcagcctgctgaagcaggctggagacgtggaggagaaccctggacctggttggtcgtgtataatcctatttctcgtagcaactgcgactggcgtccatagtgaggttcagctggtggagtctggcggtggcctggtgcagccagggggttcactccgtttgtcttgtgcggcttctggctataccttcaccaactatggtatgaactgggtccgtcaggccccgggtaagggcctggagtgggttggatggattaacacctataccggtgaaccgacctatgctgcggatttcaaacgtcgttttactttttctctggacacctccaagagcacagcttacctccagatgaacagcctgcgcgctgaggacactgccgtctattactgtgcaaagtacccgcactattatgggagcagccactggtatttcgacgtctggggacaaggaaccctggtcaccgtctcctcgggaggtggtggaagtgggggcggcggtagcggagggggtggtagcgatatacaaatgacccagtccccgtctagcctgtccgcctctgtgggcgatagggtcaccatcacctgcagcgcaagtcaggatattagcaactatttaaactggtatcaacagaaaccaggaaaagctccgaaagtcctgatttacttcacctcctctctccactctggagtcccttctcgcttctctggatccggaagtgggacggatttcactctgaccatcagcagtctgcagccagaagacttcgcaacttattactgtcaacagtatagcaccgtgccgtggacgtttggacagggtaccaaagtggaaataaaacgaggtaagcctatccctaaccctctcctcggtctcgattctacgtaagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 70 - protein, 125 aa, Artificial Sequence
  anti-CTLA-4 VH chain amino acid sequence.
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDPRGATLYYYYYGMDVWGQGTTVTVSS

SEQ ID NO: 71 - protein, 108 aa, Artificial Sequence
  anti-CTLA-4 VL chain amino acid sequence
DIQMTQSPSSLSASVGDRVTITCRASQSINSYLDWYQQKPGKAPKLLIYAASSLQSGVPSRFSGSGSGTDFTLTISSLQPEDFATYYCQQYYSTPFTFGPGTKVEIKR

SEQ ID NO: 72 - DNA, 33464 bp, Artificial Sequence
  NG-257 virus genome sequence comprising the EnAd genome with a transgene cassette encoding an anti-VEGF ScFv inserted into the region Bx
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttactgcggccgctgctaatcctttctctcttcaggccaccatgggatggagctgtatcatcctcttcttggtagcaacagctacaggtgtccactccgaggttcagctggtggagtctggcggtggcctggtgcagccagggggctcactccgtttgtcctgtgcagcttctggctataccttcaccaactatggtatgaactgggtccgtcaggccccgggtaagggcctggaatgggttggatggattaacacctataccggtgaaccgacctatgctgcggatttcaaacgtcgttttactttttctctggacacctccaagagcacagcttacctgcagatgaacagcctgcgcgctgaggacactgccgtctattactgtgcaaagtacccgcactattatgggagcagccactggtatttcgacgtctggggtcaaggaaccctggtcaccgtctcctcgggtggcggtggctcgggcggtggtggatctggtggcggcggatctgatatccagatgacccagtccccgagctccctgtccgcctctgtgggcgatagggtcaccatcacctgcagcgcaagtcaggatattagcaactatttaaactggtatcaacagaaaccaggaaaagctccgaaagtcctgatttacttcacctcctctctccactctggagtcccttctcgcttctctggatccggttctgggacggatttcactctgaccatcagcagtctgcagccagaagacttcgcaacttattactgtcaacagtatagcaccgtgccgtggacgtttggacagggtaccaaggtggagatcaaacgacatcatcaccaccaccattaagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtgggccggcctgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgctaccctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 73 - DNA, 33464 bp, Artificial Sequence; identical to SEQ ID NO: 72
  NG-281 virus genome sequence comprising the EnAd genome with a transgene cassette encoding an anti-VEGF ScFv inserted into the region Bx and a second transgene cassette encoding an anti-PD-L1 ScFv inserted into the region BY.

SEQ ID NO: 74 - DNA, 22 bp, Artificial Sequence
  Restriction site recognised and cut by the enzyme I-Cre1
caaaacgtcgtgagacagtttg

SEQ ID NO: 75 - DNA, 27 bp, Artificial Sequence
  Restriction site recognised and cut by the enzyme I-Ceu1
taactataacggtcctaaggtagcgaa

SEQ ID NO: 76 - DNA, 18 bp, Artificial Sequence
  Restriction site recognised and cut by the enzyme I-SceI
tagggataacagggtaat

SEQ ID NO: 77 - DNA, 13 bp, Artificial Sequence
  example of a start codon
gccgccrccaugg

SEQ ID NO: 78 - DNA, 34 bp, Artificial Sequence
  Primers
ttataggcgcgccctctcttaaggtagcatcggg

SEQ ID NO: 79 - DNA, 35 bp, Artificial Sequence
  Primers
ttataggcgcgccgctaccttaagagagaggttga

SEQ ID NO: 80 - DNA, 30 bp, Artificial Sequence
  Primers
ttggcggcgcgcctatctatataatatacc

SEQ ID NO: 81 - DNA, 19 bp, Artificial Sequence
  Primers
ttggcggcgcgcctatcta

SEQ ID NO: 82 - DNA, 19 bp, Artificial Sequence
  Primers
aatgcaaatctgtgagggg

SEQ ID NO: 83 - DNA, 22 bp, Artificial Sequence
  Primers
cttagtggtgttgtggtattgg

SEQ ID NO: 84 - DNA, 19 bp, Artificial Sequence
  Primers
atcgccttctatcgccttc

SEQ ID NO: 85 - DNA, 19 bp, Artificial Sequence
  Primers
agcagtgcaaatcacagtc

SEQ ID NO: 86 - DNA, 19 bp, Artificial Sequence
  Primers
caaactgagtctgctgtcg

SEQ ID NO: 87 - DNA, 19 bp, Artificial Sequence
  Primers
ataaaggggtgttgggagg

SEQ ID NO: 88 - DNA, 20 bp, Artificial Sequence
  Primers
ccctcgtaaaacctgtcatc

SEQ ID NO: 89 - DNA, 19 bp, Artificial Sequence
  Primers
cccattcgtctctccattc

SEQ ID NO: 90 - DNA, 19 bp, Artificial Sequence
  Primers
gcgatcgctaccctgcagg

We claim:

1. A replication competent group B oncolytic adenovirus comprising a sequence of formula (I):

5'TTR-$B_1$-$B_A$-$B_2$-$B_X$-$B_B$-$B_Y$-$B_3$-3'ITR wherein:
$B_1$ comprises: E1A, E1B or E1A-E1B;
$B_A$ comprises: E2B-L1-L2-L3-E2A-L4;
$B_2$ is a bond or comprises: E3;
$B_X$ is a bond or a DNA sequence comprising: a restriction site, one or more transgenes under the control of an exogenous promoter or both;
$B_B$ comprises L5;
$B_Y$ comprises a transgene cassette comprising a transgene and a splice acceptor sequence; and
$B_3$ is a bond or comprises: E4;
wherein the transgene cassette is under the control of an endogenous major late promoter and wherein the transgene cassette comprises a therapeutic gene encoding material selected from the group consisting of an RNAi sequence, a protein, an antibody or binding fragment thereof, a chemokines, a cytokines, an immunomodulator and an enzymes.

2. A replication competent adenovirus according to claim 1, wherein by also comprises the sequence shown in SEQ ID NO: 11 or a DNA sequence that hybridizes thereto under stringent conditions.

3. A replication competent adenovirus according to claim 1, wherein the splice acceptor is selected from CAGG, SEQ ID NO: 17 and SEQ ID NO: 18.

4. A replication competent adenovirus according to claim 1, wherein the transgene cassette further comprises an internal ribosome entry sequence or a high self-cleavage efficiency 2A peptide.

5. An adenovirus according to claim 4, wherein the transgene cassette encodes a high self-cleavage efficiency 2A peptide.

6. A replication competent adenovirus according to claim 1, wherein the transgene further comprises a Kozak sequence.

7. An adenovirus according to claim 6, wherein the transgene cassette comprises a Kozak sequence at the start of a protein coding sequence.

8. An adenovirus according to claim 1, wherein the transgene cassette further comprises a polyadenylation sequence.

9. An adenovirus according to claim 1, wherein the transgene cassette further comprises a restriction site at the 3' end of the DNA sequence and/or at the 5' end of the DNA sequence.

10. An adenovirus according to claim 1, wherein at least one transgene cassette encodes monocistronic mRNA.

11. An adenovirus according to claim 1, wherein at least one transgene cassette encodes a polycistronic mRNA.

12. An adenovirus according to claim 1, wherein the antibody or binding fragment thereof is specific to OX40, OX40 ligand, CD27, CD28, CD30, CD40, CD40 ligand, CD70, CD137, GITR, 4-1BB, ICOS, ICOS ligand, CTLA-4, PD-1, PD-L1, PD-L2, VISTA, B7-H3, B7-H4, HVEM, ILT-2, ILT-3, ILT-4, TIM-3, LAG-3, BTLA, LIGHT, CD160, CTLA-4 PD-L1, PD-L2, for example CD40 and CD-40 ligand.

13. An adenovirus according to claim 1, wherein the encoded protein is a cytokines independently selected from the group comprising IL-1α, IL-1β, IL-6, IL-9, IL-12, IL-13, IL-17, IL-18, IL-22, IL-23, IL-24, IL-25, IL-26, IL-27, IL-33, IL-35, IL-2, IL-4, IL-5, IL-7, IL-10, IL-15, IL-21, IL-25, IL-1RA, IFNα, IFNβ, IFNγ, TNFα, TGFβ, lymphotoxin α (LTA) and GM-CSF, for example IL-12, IL-18, IL-22, IL-7, IL-15, IL-21, IFNγ, TNFα, TGFβ and lymphotoxin α (LTA).

14. An adenovirus according to claim 1, wherein the encoded protein is a chemokine independently selected from the group comprising IL-8, CCL5, CCL17, CCL20, CCL22, CXCL9, CXCL10, CXCL11, CXCL13, CXCL12, CCL2, CCL19, CCL21, CXCR2, CCR2, CCR4, CCR5, CCR6, CCR7, CCR8, CXCR3, CXCR4, CXCR5 and CRTH2, for example CCL5, CXCL9, CXCL12, CCL2, CCL19, CCL21, CXCR2, CCR2, CCR4 and CXCR4 or a receptor thereof.

15. An adenovirus according to claim 1, wherein the transgene is a reporter gene.

16. An adenovirus according claim 1, wherein the adenovirus is Ad11.

17. An adenovirus according to claim 1, wherein the adenovirus is chimeric EnAd.

18. An adenovirus according to claim 1, wherein the virus comprises the sequence of SEQ ID NO: 52.

19. A composition comprising an adenovirus according to claim 1.

20. A method of treating a patient comprising administering a therapeutically effective amount of an adenovirus of claim 1.

21. A method of treating a patient comprising administering a therapeutically effective amount of a composition according to claim 19.

22. An adenovirus according to claim 15, wherein the reporter gene is sodium iodide symporter, intracellular metalloproteins, HSV1-tk, GFPs, luciferase or oestrogen receptor.

23. An adenovirus according to claim 1, wherein $B_X$ is a bond.

* * * * *

UNITED STATES PATENT AND TRADEMARK OFFICE
CERTIFICATE OF CORRECTION

PATENT NO. : 9,987,314 B2
APPLICATION NO. : 15/031716
DATED : June 5, 2018
INVENTOR(S) : Brian Robert Champion et al.

Page 1 of 1

It is certified that error appears in the above-identified patent and that said Letters Patent is hereby corrected as shown below:

In the Specification

Column 46, Line 52, replace "by" with --bp--

Column 46, Line 53, replace "By" with --$B_Y$--

Column 46, Line 54, replace "by" with --bp--

In the Claims

Column 79, Claim 1, Line 27, replace "By" with --$B_Y$--

Column 79, Claim 1, Lines 30-36, replace "wherein the transgene cassette is under the control of an endogenous major late promoter and wherein the transgene cassette comprises a therapeutic gene encoding material selected from the group consisting of an RNAi sequence, a protein, an antibody or binding fragment thereof, a chemokines, a cytokines, an immunomodulator and an enzymes." with --wherein the transgene cassette is under the control of an endogenous major late promoter and wherein the transgene cassette comprises at least one therapeutic gene encoding material selected from the group consisting of an RNAi sequence, a protein, an antibody or binding fragment thereof, a chemokine, a cytokine, an immunomodulator and an enzyme.--

Column 79, Claim 2, Line 38, replace "by" with --$B_Y$--

Column 80, Claim 13, Line 26, replace "cytokines" with --cytokine--

Signed and Sealed this
Thirtieth Day of June, 2020

Andrei Iancu
*Director of the United States Patent and Trademark Office*